United States Patent
Houghton et al.

(10) Patent No.: US 10,300,131 B2
(45) Date of Patent: May 28, 2019

(54) HEPATITIS C VIRUS IMMUNOGENIC COMPOSITIONS AND METHODS OF USE THEREOF

(71) Applicant: THE GOVERNORS OF THE UNIVERSITY OF ALBERTA, Edmonton, Alberta (CA)

(72) Inventors: Michael Houghton, Danville, CA (US); John L. Law, Edmonton (CA); Michael Logan, Edmonton (CA); Darren Hockman, Edmonton (CA); Abdolamir Landi, Edmonton (CA)

(73) Assignee: THE GOVERNORS OF THE UNIVERSITY OF ALBERTA, Edmonton, Alberta (CA)

( * ) Notice: Subject to any disclaimer, the term of this patent is extended or adjusted under 35 U.S.C. 154(b) by 0 days.

(21) Appl. No.: 15/574,427

(22) PCT Filed: Jul. 6, 2016

(86) PCT No.: PCT/IB2016/001051
§ 371 (c)(1),
(2) Date: Nov. 15, 2017

(87) PCT Pub. No.: WO2017/006182
PCT Pub. Date: Jan. 12, 2017

(65) Prior Publication Data
US 2018/0169219 A1    Jun. 21, 2018

Related U.S. Application Data

(60) Provisional application No. 62/189,657, filed on Jul. 7, 2015.

(51) Int. Cl.
    A61K 39/00    (2006.01)
    A61K 39/21    (2006.01)
    A61K 39/295   (2006.01)
    A61K 48/00    (2006.01)
    C12N 15/86    (2006.01)
    A61K 39/29    (2006.01)
    A61K 39/12    (2006.01)
    A61P 37/04    (2006.01)
    A61P 31/14    (2006.01)
    A61P 31/04    (2006.01)
    C12N 15/861   (2006.01)

(52) U.S. Cl.
    CPC .............. A61K 39/29 (2013.01); A61K 39/12 (2013.01); A61K 39/295 (2013.01); A61P 31/04 (2018.01); A61P 31/14 (2018.01); A61P 37/04 (2018.01); C12N 15/861 (2013.01); A61K 2039/55544 (2013.01); C07K 2319/00 (2013.01); C12N 2770/24234 (2013.01)

(58) Field of Classification Search
    CPC ............ A61K 39/12; A61K 2039/5256; A61K 2039/5258; A61K 2039/575; C07K 14/005
    See application file for complete search history.

(56) References Cited

FOREIGN PATENT DOCUMENTS

| EP | 2915544 A1 | 9/2015 |
|----|-----------|--------|
| WO | WO 2007/081848 | 7/2007 |
| WO | WO 2008/024518 | 2/2008 |
| WO | WO2008024518 | * 2/2008 |
| WO | WO 2014/060851 | 4/2014 |

OTHER PUBLICATIONS

Gededzha, et al.; "Prediction of T-cell epitopes of hepatitis C virus genotype 5a"; Virology Journal; vol. 11, No. 187, 13 pages (2014).
Prabdial-Sing, et al.; "Sequence-based in silico analysis of well studied Hepatitis C Virus epitopes and their variants in other genotypes (particularly genotype 5a) against South African human leukocyte antigen backgrounds"; BMC Immunology; vol. 13, No. 67, 15 pages (2012).
Shehzadi, et al; "Promiscuous prediction and conservancy analysis of CTL binding epitopes of HCV 3a viral proteome from Punjab Pakistan: an in Silico Approach"; Virology Journal; vol. 8, No. 55, 13 pages (2011).
Terpe, et al.; "Overview of tag protein fusions: from molecular and biochemical fundamentals to commercial systems"; Appl. Microbiol. Biotechnol; vol. 60, No. 5, pp. 523-533 (Jan. 2003).
Verstrepen, et al.; "Immune mechanisms of vaccine induced protection against chronic hepatitis C virus infection in chimpanzees"; World Journal of Hepatology; vol. 7, No. 1, pp. 53-69 (Jan. 27, 2015).

(Continued)

Primary Examiner — Barry A Chestnut
(74) Attorney, Agent, or Firm — Bozicevic Field & Francis, LLP; Paula A. Borden

(57) ABSTRACT

The present disclosure provides heterodimeric polypeptides comprising: 1) a variant hepatitis C virus (HCV) E2 polypeptide and an HCV E1 polypeptide; 2) a variant HCV E1 polypeptide and an HCV E2 polypeptide; or 3) a variant HCV E1 polypeptide and a variant HCV E2 polypeptide, where the variant HCV E2 polypeptide and/or the HCV E1 polypeptide comprises one or more T cell epitopes, present in an HCV polypeptide other than an HCV E1 polypeptide or an HCV E2 polypeptide. The present disclosure provides nucleic acids encoding a polyprotein that includes E1 and variant E2, E2 and variant E1, or variant E2 and variant E1. The present disclosure provides a method of producing an E1/E2 heterodimer of the present disclosure. The present disclosure provides a method of inducing an immune response in an individual. The present disclosure provides variant E2 polypeptides and variant E1 polypeptides; and nucleic acids encoding same.

Figure 4A:
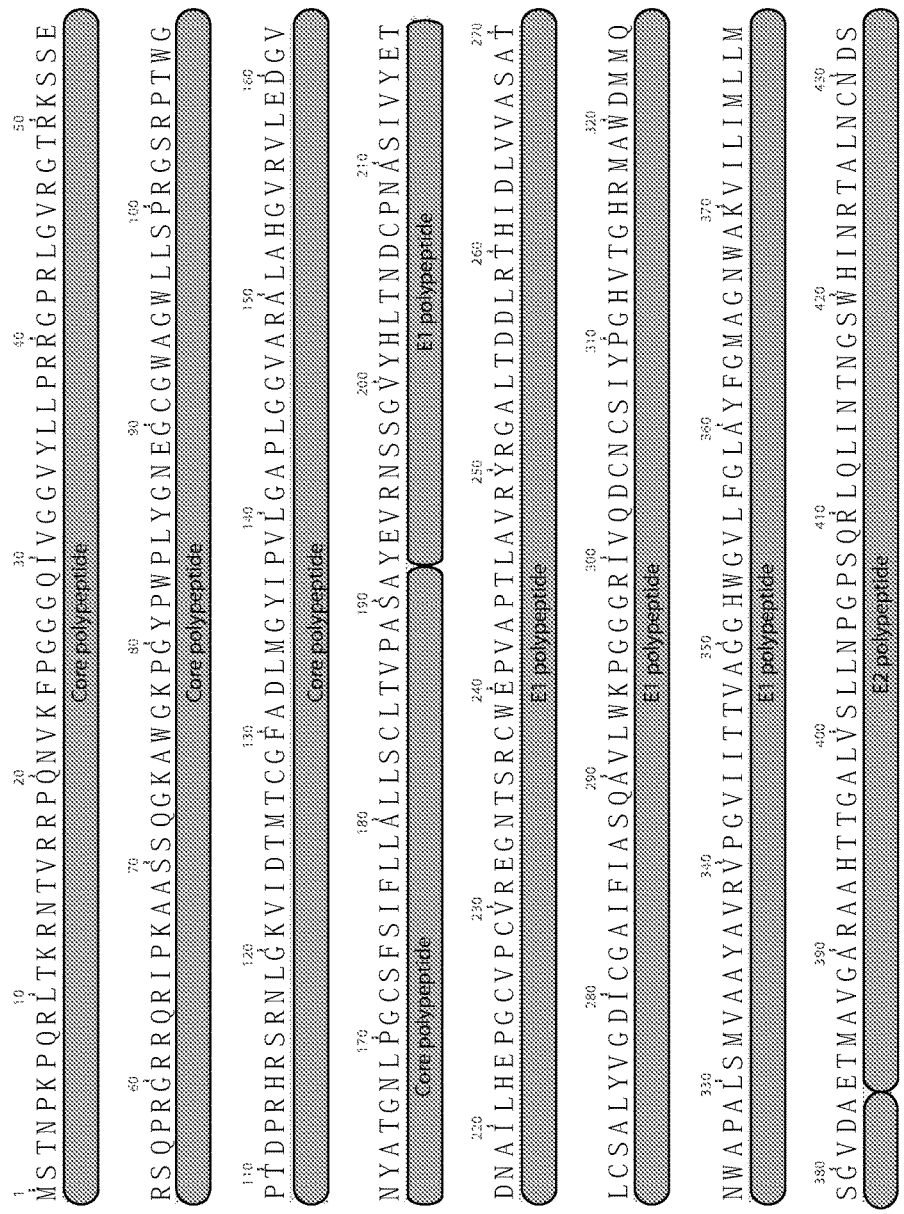

27 Claims, 55 Drawing Sheets
**Specification includes a

(56) References Cited

OTHER PUBLICATIONS

Whidby, et al.; "Blocking hepatitis C virus infection with recombinant form of envelope protein 2 ectodomain"; J. Virol.; vol. 83, No. 21, pp. 11078-11089 (Nov. 2009).

Yusim, et al.; "Hepatitis C Genotype 1 Mosaic Vaccines Are Immunogenic in Mice and Induce Stronger T-Cell Responses than Natural Strains"; Clinical and Vaccine Immunology; vol. 20, No. 2, pp. 302-305 (Feb. 2013).

Zeng, et al.; "A novel combined vaccine candidate containing epitopes of HCV NS3, core and E1 proteins induces multi-specific immune responses in BALB/c mice"; Antiviral Research; vol. 84, pp. 23-30 (2009).

Botti, et al.; "The Hepatitis C Virus E1 Glycoprotein Undergoes Productive Folding but Accelerated Degradation When Expressed as an Individual Subunit in CHO Cells"; PLoS One; vol. 6, No. 8, 10 pages (Aug. 2011).

Fournillier, et al.; "Expression of Noncovalent Hepatitis C Virus Envelope E1-E2 Complexes Is Not Required for the Induction of Antibodies with Neutralizing Properties following DNA Immunization"; Journal of Virology; vol. 73, No. 9, pp. 7497-7504 (Sep. 1999).

Law, et al.; "Progress towards a hepatitis C virus vaccine"; Emerging Microbes and Infections; vol. 2, No. 11, 6 pages (2013).

Logan, et al.; "Native Folding of a Recombinant gpE1/gpE2 Heterodimer Vaccine Antigen from a Precursor Protein Fused with Fc IgG"; Journal of Virology; vol. 91, No. 1, 14 pages (Jan. 2017).

Seong, et al.; "Immunogenicity of the E1E2 proteins of hepatitis C virus expressed by recombinant adenoviruses"; Vaccine; vol. 19, pp. 2955-2964 (2001).

* cited by examiner

LQTGFIAALFYTHRFNSSGCPERMASCKPLSDFDQGWGPLWYNSTERPSDQRPY
E2 polypeptide

CWHYAPSPCGIVPAKDVCGPVYCFTPSPVVVGTTDRRGVPTYTWGENESDVFLL
E2 polypeptide

NSTRPPQGSWFGCCSWMNTTGFTKTCGGPPCKIRPQGAQSNTSLTCPTDCFRKHP
E2 polypeptide

RATY

```
                          1         10        20        30        40        50        60        70        80
AVI1a129             MDAMKRGLCCVLLLCGAVFVSPSYQVRNSTGLYHVTNDCPNSSIVYEAADAILHTPGCVPCVREGNTSRCWVAMTPTVATRDGK
AVI1a129 TP29        MDAMKRGLCCVLLLCGAVFVSPSYQVRNSTGLYHVTNDCPNSSIVYEAADAILHTPGCVPCVREGNTSRCWVAMTPTVATRDGK
AVI1a129 TP52        MDAMKRGLCCVLLLCGAVFVSPSYQVRNSTGLYHVTNDCPNSSIVYEAADAILHTPGCVPCVREGNTSRCWVAMTPTVATRDGK
AVI1a129 TP100       MDAMKRGLCCVLLLCGAVFVSPSYQVRNSTGLYHVTNDCPNSSIVYEAADAILHTPGCVPCVREGNTSRCWVAMTPTVATRDGK
H77                  MDAMKRGLCCVLLLCGAVFVSPSYQVRNSSGLYHVTNDCPNSSIVYEAADAILHTPGCVPCVREGNASRCWVAVTPTVATRDGK
H77 TP29             MDAMKRGLCCVLLLCGAVFVSPSYQVRNSSGLYHVTNDCPNSSIVYEAADAILHTPGCVPCVREGNASRCWVAVTPTVATRDGK
H77 TP52             MDAMKRGLCCVLLLCGAVFVSPSYQVRNSSGLYHVTNDCPNSSIVYEAADAILHTPGCVPCVREGNASRCWVAVTPTVATRDGK
H77 TP100            MDAMKRGLCCVLLLCGAVFVSPSYQVRNSSGLYHVTNDCPNSSIVYEAADAILHTPGCVPCVREGNASRCWVAVTPTVATRDGK
                     [tPA Signal Sequence]                                              [E1]

90       100       110       120       130       140       150       160
AVI1a129             LPTTQLRRHIDLLVGSATLCSALYVGDLCGSIFLVGQMFTFSPRRHWTTQDCNCSLYPGHITGHRMAWDMMMNWSPTAALITAQ
AVI1a129 TP29        LPTTQLRRHIDLLVGSATLCSALYVGDLCGSIFLVGQMFTFSPRRHWTTQDCNCSLYPGHITGHRMAWDMMMNWSPTAALITAQ
AVI1a129 TP52        LPTTQLRRHIDLLVGSATLCSALYVGDLCGSIFLVGQMFTFSPRRHWTTQDCNCSLYPGHITGHRMAWDMMMNWSPTAALITAQ
AVI1a129 TP100       LPTTQLRRHIDLLVGSATLCSALYVGDLCGSIFLVGQMFTFSPRRHWTTQDCNCSLYPGHITGHRMAWDMMMNWSPTAALITAQ
H77                  LPTTQLRRHIDLLVGSATLCSALYVGDLCGSVFLVGQLFTFSPRRHWTTQDCNCSIYPGHITGHRMAWDMMMNWSPTAALVVAQ
H77 TP29             LPTTQLRRHIDLLVGSATLCSALYVGDLCGSVFLVGQLFTFSPRRHWTTQDCNCSIYPGHITGHRMAWDMMMNWSPTAALVVAQ
H77 TP52             LPTTQLRRHIDLLVGSATLCSALYVGDLCGSVFLVGQLFTFSPRRHWTTQDCNCSIYPGHITGHRMAWDMMMNWSPTAALVVAQ
H77 TP100            LPTTQLRRHIDLLVGSATLCSALYVGDLCGSVFLVGQLFTFSPRRHWTTQDCNCSIYPGHITGHRMAWDMMMNWSPTAALVVAQ
                                                            [E1]

170       180       190       200       210       220       230       240       250
AVI1a129             LLRIPQAILDMIAGAHWGVLAGIAYFSMVGNWAKVLVVLLLFAGVDAQTDKTHTCPPCPAPEAEGAPSVFLFPPKPKDTLMISR
AVI1a129 TP29        LLRIPQAILDMIAGAHWGVLAGIAYFSMVGNWAKVLVVLLLFAGVDAQTDKTHTCPPCPAPEAEGAPSVFLFPPKPKDTLMISR
AVI1a129 TP52        LLRIPQAILDMIAGAHWGVLAGIAYFSMVGNWAKVLVVLLLFAGVDAQTDKTHTCPPCPAPEAEGAPSVFLFPPKPKDTLMISR
AVI1a129 TP100       LLRIPQAILDMIAGAHWGVLAGIAYFSMVGNWAKVLVVLLLFAGVDAQTDKTHTCPPCPAPEAEGAPSVFLFPPKPKDTLMISR
H77                  LLRIPQAIMDMIAGAHWGVLAGIAYFSMVGNWAKVLVVLLLFAGVDAETDKTHTCPPCPAPEAEGAPSVFLFPPKPKDTLMISR
H77 TP29             LLRIPQAIMDMIAGAHWGVLAGIAYFSMVGNWAKVLVVLLLFAGVDAETDKTHTCPPCPAPEAEGAPSVFLFPPKPKDTLMISR
H77 TP52             LLRIPQAIMDMIAGAHWGVLAGIAYFSMVGNWAKVLVVLLLFAGVDAETDKTHTCPPCPAPEAEGAPSVFLFPPKPKDTLMISR
H77 TP100            LLRIPQAIMDMIAGAHWGVLAGIAYFSMVGNWAKVLVVLLLFAGVDAETDKTHTCPPCPAPEAEGAPSVFLFPPKPKDTLMISR
                                        [E1]                           ↑   [FC Tag]
                                                                       *

260       270       280       290       300       310       320       330
AVI1a129             TPEVTCVVVDVSHEDPEVKFNWYVDGVEVHNAKTKPREEQYNSTYRVVSVLTVLHQDWLNGKEYKCKVSNKALPAPIEKTISKA
AVI1a129 TP29        TPEVTCVVVDVSHEDPEVKFNWYVDGVEVHNAKTKPREEQYNSTYRVVSVLTVLHQDWLNGKEYKCKVSNKALPAPIEKTISKA
AVI1a129 TP52        TPEVTCVVVDVSHEDPEVKFNWYVDGVEVHNAKTKPREEQYNSTYRVVSVLTVLHQDWLNGKEYKCKVSNKALPAPIEKTISKA
AVI1a129 TP100       TPEVTCVVVDVSHEDPEVKFNWYVDGVEVHNAKTKPREEQYNSTYRVVSVLTVLHQDWLNGKEYKCKVSNKALPAPIEKTISKA
H77                  TPEVTCVVVDVSHEDPEVKFNWYVDGVEVHNAKTKPREEQYNSTYRVVSVLTVLHQDWLNGKEYKCKVSNKALPAPIEKTISKA
H77 TP29             TPEVTCVVVDVSHEDPEVKFNWYVDGVEVHNAKTKPREEQYNSTYRVVSVLTVLHQDWLNGKEYKCKVSNKALPAPIEKTISKA
H77 TP52             TPEVTCVVVDVSHEDPEVKFNWYVDGVEVHNAKTKPREEQYNSTYRVVSVLTVLHQDWLNGKEYKCKVSNKALPAPIEKTISKA
H77 TP100            TPEVTCVVVDVSHEDPEVKFNWYVDGVEVHNAKTKPREEQYNSTYRVVSVLTVLHQDWLNGKEYKCKVSNKALPAPIEKTISKA
                                                            [FC Tag]

340       350       360       370       380       390       400       410       420
AVI1a129             KGQPREPQVYTLPPSREEMTKNQVSLTCLVKGFYPSDIAVEWESNGQPENNYKTTPPVLDSDGSFFLYSKLTVDKSRWQQGNVF
AVI1a129 TP29        KGQPREPQVYTLPPSREEMTKNQVSLTCLVKGFYPSDIAVEWESNGQPENNYKTTPPVLDSDGSFFLYSKLTVDKSRWQQGNVF
AVI1a129 TP52        KGQPREPQVYTLPPSREEMTKNQVSLTCLVKGFYPSDIAVEWESNGQPENNYKTTPPVLDSDGSFFLYSKLTVDKSRWQQGNVF
AVI1a129 TP100       KGQPREPQVYTLPPSREEMTKNQVSLTCLVKGFYPSDIAVEWESNGQPENNYKTTPPVLDSDGSFFLYSKLTVDKSRWQQGNVF
H77                  KGQPREPQVYTLPPSREEMTKNQVSLTCLVKGFYPSDIAVEWESNGQPENNYKTTPPVLDSDGSFFLYSKLTVDKSRWQQGNVF
H77 TP29             KGQPREPQVYTLPPSREEMTKNQVSLTCLVKGFYPSDIAVEWESNGQPENNYKTTPPVLDSDGSFFLYSKLTVDKSRWQQGNVF
H77 TP52             KGQPREPQVYTLPPSREEMTKNQVSLTCLVKGFYPSDIAVEWESNGQPENNYKTTPPVLDSDGSFFLYSKLTVDKSRWQQGNVF
H77 TP100            KGQPREPQVYTLPPSREEMTKNQVSLTCLVKGFYPSDIAVEWESNGQPENNYKTTPPVLDSDGSFFLYSKLTVDKSRWQQGNVF
                                                            [FC Tag]

430       440       450       460       470       480       490       500
AVI1a129             SCSVMHEALHNHYTQKSLSLSPGKLEVLFQGP--------------------------------
AVI1a129 TP29        SCSVMHEALHNHYTQKSLSLSPGKLEVLFQGP--------------AIPLEVIKGGRHLIFCHSKKKCDELAAKL----------
AVI1a129 TP52        SCSVMHEALHNHYTQKSLSLSPGKLEVLFQGP--------------AIPLEVIKGGRHLIFCHSKKKCDELAAKLVALGINAVA
AVI1a129 TP100       SCSVMHEALHNHYTQKSLSLSPGKLEVLFQGPVALSTTGEIPFYGKAIPLEVIKGGRHLIFCHSKKKCDELAAKLVALGINAVA
H77                  SCSVMHEALHNHYTQKSLSLSPGKLEVLFQGP--------------------------------
H77 TP29             SCSVMHEALHNHYTQKSLSLSPGKLEVLFQGP--------------AIPLEVIKGGRHLIFCHSKKKCDELAAKL----------
H77 TP52             SCSVMHEALHNHYTQKSLSLSPGKLEVLFQGP--------------AIPLEVIKGGRHLIFCHSKKKCDELAAKLVALGINAVA
H77 TP100            SCSVMHEALHNHYTQKSLSLSPGKLEVLFQGPVALSTTGEIPFYGKAIPLEVIKGGRHLIFCHSKKKCDELAAKLVALGINAVA
                            [FC Tag]           [PP Site]                              [TPx]
```

FIG. 6A

```
              510        520        530        540        550        560        570        580
AVI1a129      ----------------------------------------------QTHVTGGRAAHITAGLTSLFSPGPSQKLQLVNTNGS
AVI1a129 TP29 ----------------------------------------------QTHVTGGRAAHITAGLTSLFSPGPSQKLQLVNTNGS
AVI1a129 TP52 YYRGLDVSVIPTS---------------------------------QTHVTGGRAAHITAGLTSLFSPGPSQKLQLVNTNGS
AVI1a129 TP100 YYRGLDVSVIPTSGDVVVVATDALMTGFTGDFDSVIDCNTCVTQTVDFQTHVTGGRAAHITAGLTSLFSPGPSQKLQLVNTNGS
H77           ----------------------------------------------ETHVTGGSAGRTTAGLVGLLTPGAKQNIQLINTNGS
H77 TP29      ----------------------------------------------ETHVTGGSAGRTTAGLVGLLTPGAKQNIQLINTNGS
H77 TP52      YYRGLDVSVIPTS---------------------------------ETHVTGGSAGRTTAGLVGLLTPGAKQNIQLINTNGS
H77 TP100     YYRGLDVSVIPTSGDVVVVATDALMTGFTGDFDSVIDCNTCVTQTVDFETHVTGGSAGRTTAGLVGLLTPGAKQNIQLINTNGS
                                        TPx                              E2 Protein 590        600        610        620        630        640        650        660        670
AVI1a129      WHINSTALNCNDSLKTGWIAGLLYSYKFNSSGCPERLASCRRLTDFAQGWGPISHANGSGPDERPYCWHYPPRPCGIVPAKSVC
AVI1a129 TP29 WHINSTALNCNDSLKTGWIAGLLYSYKFNSSGCPERLASCRRLTDFAQGWGPISHANGSGPDERPYCWHYPPRPCGIVPAKSVC
AVI1a129 TP52 WHINSTALNCNDSLKTGWIAGLLYSYKFNSSGCPERLASCRRLTDFAQGWGPISHANGSGPDERPYCWHYPPRPCGIVPAKSVC
AVI1a129 TP100 WHINSTALNCNDSLKTGWIAGLLYSYKFNSSGCPERLASCRRLTDFAQGWGPISHANGSGPDERPYCWHYPPRPCGIVPAKSVC
H77           WHINSTALNCNESLNTGWLAGLFYQHKFNSSGCPERLASCRRLTDFAQGWGPISYANGSGLDERPYCWHYPPRPCGIVPAKSVC
H77 TP29      WHINSTALNCNESLNTGWLAGLFYQHKFNSSGCPERLASCRRLTDFAQGWGPISYANGSGLDERPYCWHYPPRPCGIVPAKSVC
H77 TP52      WHINSTALNCNESLNTGWLAGLFYQHKFNSSGCPERLASCRRLTDFAQGWGPISYANGSGLDERPYCWHYPPRPCGIVPAKSVC
H77 TP100     WHINSTALNCNESLNTGWLAGLFYQHKFNSSGCPERLASCRRLTDFAQGWGPISYANGSGLDERPYCWHYPPRPCGIVPAKSVC
                                                    E2 Protein 680        690        700        710        720        730        740        750
AVI1a129      GPVYCFTPSPVVVGTTDKSGAPTYNWGENDWDVFVLNNTRPPLGNWFGCTWMNSTGFTKVCGAPPCVIGGAGNNTLRCPTDCFR
AVI1a129 TP29 GPVYCFTPSPVVVGTTDKSGAPTYNWGENDWDVFVLNNTRPPLGNWFGCTWMNSTGFTKVCGAPPCVIGGAGNNTLRCPTDCFR
AVI1a129 TP52 GPVYCFTPSPVVVGTTDKSGAPTYNWGENDWDVFVLNNTRPPLGNWFGCTWMNSTGFTKVCGAPPCVIGGAGNNTLRCPTDCFR
AVI1a129 TP100 GPVYCFTPSPVVVGTTDKSGAPTYNWGENDWDVFVLNNTRPPLGNWFGCTWMNSTGFTKVCGAPPCVIGGAGNNTLRCPTDCFR
H77           GPVYCFTPSPVVVGTTDRSGAPTYSWGANDTDVFVLNNTRPPLGNWFGCTWMNSTGFTKVCGAPPCVIGGVGNNTLLCPTDCFR
H77 TP29      GPVYCFTPSPVVVGTTDRSGAPTYSWGANDTDVFVLNNTRPPLGNWFGCTWMNSTGFTKVCGAPPCVIGGVGNNTLLCPTDCFR
H77 TP52      GPVYCFTPSPVVVGTTDRSGAPTYSWGANDTDVFVLNNTRPPLGNWFGCTWMNSTGFTKVCGAPPCVIGGVGNNTLLCPTDCFR
H77 TP100     GPVYCFTPSPVVVGTTDRSGAPTYSWGANDTDVFVLNNTRPPLGNWFGCTWMNSTGFTKVCGAPPCVIGGVGNNTLLCPTDCFR
                                                    E2 Protein 760        770        780        790        800        810        820        830        840
AVI1a129      KHPDATYSRCGSGPWITPRCLVDYPYRLWHYPCTVNYSIFKIRMYLGGVEHRLEAACNWTRGERCDLEDRDRSELSPLLLSTTQ
AVI1a129 TP29 KHPDATYSRCGSGPWITPRCLVDYPYRLWHYPCTVNYSIFKIRMYLGGVEHRLEAACNWTRGERCDLEDRDRSELSPLLLSTTQ
AVI1a129 TP52 KHPDATYSRCGSGPWITPRCLVDYPYRLWHYPCTVNYSIFKIRMYLGGVEHRLEAACNWTRGERCDLEDRDRSELSPLLLSTTQ
AVI1a129 TP100 KHPDATYSRCGSGPWITPRCLVDYPYRLWHYPCTVNYSIFKIRMYLGGVEHRLEAACNWTRGERCDLEDRDRSELSPLLLSTTQ
H77           KHPEATYSRCGSGPWITPRCMVDYPYRLWHYPCTINYTIFKVRMYVGGVEHRLEAACNWTRGERCDLEDRDRSELSPLLLSTTQ
H77 TP29      KHPEATYSRCGSGPWITPRCMVDYPYRLWHYPCTINYTIFKVRMYVGGVEHRLEAACNWTRGERCDLEDRDRSELSPLLLSTTQ
H77 TP52      KHPEATYSRCGSGPWITPRCMVDYPYRLWHYPCTINYTIFKVRMYVGGVEHRLEAACNWTRGERCDLEDRDRSELSPLLLSTTQ
H77 TP100     KHPEATYSRCGSGPWITPRCMVDYPYRLWHYPCTINYTIFKVRMYVGGVEHRLEAACNWTRGERCDLEDRDRSELSPLLLSTTQ
                                                    E2 Protein 850        860        870        880        890        900        910   915
AVI1a129      WQVLPCSFTTLPALSTGLIHLHQNIVDVQYLYGVGSSVASWAIKWDYVVLLFLLLADARICSCLWMMLLISQAEA
AVI1a129 TP29 WQVLPCSFTTLPALSTGLIHLHQNIVDVQYLYGVGSSVASWAIKWDYVVLLFLLLADARICSCLWMMLLISQAEA
AVI1a129 TP52 WQVLPCSFTTLPALSTGLIHLHQNIVDVQYLYGVGSSVASWAIKWDYVVLLFLLLADARICSCLWMMLLISQAEA
AVI1a129 TP100 WQVLPCSFTTLPALSTGLIHLHQNIVDVQYLYGVGSSVASWAIKWDYVVLLFLLLADARICSCLWMMLLISQAEA
H77           WQVLPCSFTTLPALSTGLIHLHQNIVDVQYLYGVGSSIASWAIKWEYVVLLFLLLADARVCSCLWMMLLISQAEA
H77 TP29      WQVLPCSFTTLPALSTGLIHLHQNIVDVQYLYGVGSSIASWAIKWEYVVLLFLLLADARVCSCLWMMLLISQAEA
H77 TP52      WQVLPCSFTTLPALSTGLIHLHQNIVDVQYLYGVGSSIASWAIKWEYVVLLFLLLADARVCSCLWMMLLISQAEA
H77 TP100     WQVLPCSFTTLPALSTGLIHLHQNIVDVQYLYGVGSSIASWAIKWEYVVLLFLLLADARVCSCLWMMLLISQAEA
                                                    E2 Protein
```

FIG. 6B

```
                       590        600        610        620        630        640        650        660
S52             ----------------------------------------------------ETYVTGGSVAHSARGLTSLFSMGAKQKLQ
S52 TP29        ----------------------------------------------------ETYVTGGSVAHSARGLTSLFSMGAKQKLQ
S52 TP52        GINAVAYYRGLDVSVIPTS---------------------------------ETYVTGGSVAHSARGLTSLFSMGAKQKLQ
S52 TP100       GINAVAYYRGLDVSVIPTSGDVVVVATDALMTGFTGDFDSVIDCNTCVTQTVDFETYVTGGSVAHSARGLTSLFSMGAKQKLQ
AVI3a177        ----------------------------------------------------ETHTTGGTAARNAFTLTGLFTQGARQKLE
AVI3a177 TP29   ----------------------------------------------------ETHTTGGTAARNAFTLTGLFTQGARQKLE
AVI3a177 TP52   GINAVAYYRGLDVSVIPTSG--------------------------------ETHTTGGTAARNAFTLTGLFTQGARQKLE
AVI3a177 TP100  GINAVAYYRGLDVSVIPTSGDVVVVATDALMTGFTGDFDSVIDCNTCVTQTVDFETHTTGGTAARNAFTLTGLFTQGARQKLE

S52             LVNTNGSWHINSTALNCNESINTGFIAGLFYYHKFNSTGCPQRLSSCKPIISFRQGWGPLTDANITGPSDDRPYCWHYAPRPC
S52 TP29        LVNTNGSWHINSTALNCNESINTGFIAGLFYYHKFNSTGCPQRLSSCKPIISFRQGWGPLTDANITGPSDDRPYCWHYAPRPC
S52 TP52        LVNTNGSWHINSTALNCNESINTGFIAGLFYYHKFNSTGCPQRLSSCKPIISFRQGWGPLTDANITGPSDDRPYCWHYAPRPC
S52 TP100       LVNTNGSWHINSTALNCNESINTGFIAGLFYYHKFNSTGCPQRLSSCKPIISFRQGWGPLTDANITGPSDDRPYCWHYAPRPC
AVI3a177        LINTNGSWHINRTALNCNESLNTGFIAGLFYLHKFNSTGCPERLSSCKPITFFRQGWGSLTDANITGPSDDKPYCWHYAPRPC
AVI3a177 TP29   LINTNGSWHINRTALNCNESLNTGFIAGLFYLHKFNSTGCPERLSSCKPITFFRQGWGSLTDANITGPSDDKPYCWHYAPRPC
AVI3a177 TP52   LINTNGSWHINRTALNCNESLNTGFIAGLFYLHKFNSTGCPERLSSCKPITFFRQGWGSLTDANITGPSDDKPYCWHYAPRPC
AVI3a177 TP100  LINTNGSWHINRTALNCNESLNTGFIAGLFYLHKFNSTGCPERLSSCKPITFFRQGWGSLTDANITGPSDDKPYCWHYAPRPC

S52             SVVPASSVCGPVYCFTPSPVVVGTTDIKGKPTYNWGENETDVFLLESLRPPSGRWFGCAWMNSTGFLKTCGAPPCNIYGGEGD
S52 TP29        SVVPASSVCGPVYCFTPSPVVVGTTDIKGKPTYNWGENETDVFLLESLRPPSGRWFGCAWMNSTGFLKTCGAPPCNIYGGEGD
S52 TP52        SVVPASSVCGPVYCFTPSPVVVGTTDIKGKPTYNWGENETDVFLLESLRPPSGRWFGCAWMNSTGFLKTCGAPPCNIYGGEGD
S52 TP100       SVVPASSVCGPVYCFTPSPVVVGTTDIKGKPTYNWGENETDVFLLESLRPPSGRWFGCAWMNSTGFLKTCGAPPCNIYGGEGD
AVI3a177        EVVPALNVCGPVYCFTPSPVVVGTTDRQGVPTYTWGENETDVFLLRSLRPPSGQWFGCTWMNSTGFVKTCGAPPCDIYGGGGN
AVI3a177 TP29   EVVPALNVCGPVYCFTPSPVVVGTTDRQGVPTYTWGENETDVFLLRSLRPPSGQWFGCTWMNSTGFVKTCGAPPCDIYGGGGN
AVI3a177 TP52   EVVPALNVCGPVYCFTPSPVVVGTTDRQGVPTYTWGENETDVFLLRSLRPPSGQWFGCTWMNSTGFVKTCGAPPCDIYGGGGN
AVI3a177 TP100  EVVPALNVCGPVYCFTPSPVVVGTTDRQGVPTYTWGENETDVFLLRSLRPPSGQWFGCTWMNSTGFVKTCGAPPCDIYGGGGN

S52             PENETDLFCPTDCFRKHPEATYSRCGAGPWLTPRCMVDYPYRLWHYPCTVNFTLFKVRMFVGGFEHRFTAACNWTRGERCNIE
S52 TP29        PENETDLFCPTDCFRKHPEATYSRCGAGPWLTPRCMVDYPYRLWHYPCTVNFTLFKVRMFVGGFEHRFTAACNWTRGERCNIE
S52 TP52        PENETDLFCPTDCFRKHPEATYSRCGAGPWLTPRCMVDYPYRLWHYPCTVNFTLFKVRMFVGGFEHRFTAACNWTRGERCNIE
S52 TP100       PENETDLFCPTDCFRKHPEATYSRCGAGPWLTPRCMVDYPYRLWHYPCTVNFTLFKVRMFVGGFEHRFTAACNWTRGERCNIE
AVI3a177        RCNESDLFCPTDCFRKHPEATYSRCGAGPWLTPRCLVDYPYRLWHYPCTVNFTLFKVRMFVGGFEHRFTAACNWTRGERCNIE
AVI3a177 TP29   RCNESDLFCPTDCFRKHPEATYSRCGAGPWLTPRCLVDYPYRLWHYPCTVNFTLFKVRMFVGGFEHRFTAACNWTRGERCNIE
AVI3a177 TP52   RCNESDLFCPTDCFRKHPEATYSRCGAGPWLTPRCLVDYPYRLWHYPCTVNFTLFKVRMFVGGFEHRFTAACNWTRGERCNIE
AVI3a177 TP100  RCNESDLFCPTDCFRKHPEATYSRCGAGPWLTPRCLVDYPYRLWHYPCTVNFTLFKVRMFVGGFEHRFTAACNWTRGERCNIE

S52             DRDRSEQHPLLHSTTELAILPCSFTPMPALSTGLIHLHQNIVDVQYLYGVGSDMVGWALKWEFVILVFLLLADARVCVALWLM
S52 TP29        DRDRSEQHPLLHSTTELAILPCSFTPMPALSTGLIHLHQNIVDVQYLYGVGSDMVGWALKWEFVILVFLLLADARVCVALWLM
S52 TP52        DRDRSEQHPLLHSTTELAILPCSFTPMPALSTGLIHLHQNIVDVQYLYGVGSDMVGWALKWEFVILVFLLLADARVCVALWLM
S52 TP100       DRDRSEQHPLLHSTTELAILPCSFTPMPALSTGLIHLHQNIVDVQYLYGVGSDMVGWALKWEFVILVFLLLADARVCVALWLM
AVI3a177        DRDRSEQHPLLHSTTELAILPCSFTPMPALSTGLIHLHQNIVDVQYLYGVGSGVVGWALRWEFVVLVFLLLADARVCVALWLM
AVI3a177 TP29   DRDRSEQHPLLHSTTELAILPCSFTPMPALSTGLIHLHQNIVDVQYLYGVGSGVVGWALRWEFVVLVFLLLADARVCVALWLM
AVI3a177 TP52   DRDRSEQHPLLHSTTELAILPCSFTPMPALSTGLIHLHQNIVDVQYLYGVGSGVVGWALRWEFVVLVFLLLADARVCVALWLM
AVI3a177 TP100  DRDRSEQHPLLHSTTELAILPCSFTPMPALSTGLIHLHQNIVDVQYLYGVGSGVVGWALRWEFVVLVFLLLADARVCVALWLM

S52             LMVSQAEA
S52 TP29        LMVSQAEA
S52 TP52        LMVSQAEA
S52 TP100       LMVSQAEA
AVI3a177        LMISQAEA
AVI3a177 TP29   LMISQAEA
AVI3a177 TP52   LMISQAEA
AVI3a177 TP100  LMISQAEA
```

FIG. 7B

FIG. 9A
GenBank 3S7G_A
*Homo sapiens* IgG1 Fc
227 aa

```
  1 dkthtcppcp apellggpsv flfppkpkdt lmisrtpevt cvvvdvshed pevkfnwyvd
 61 gvevhnaktk preeqynsty rvvsvltvlh qdwlngkeyk ckvsnkalpa piektiskak
121 gqprepqvyt lppsrdeltk nqvsltclvk gfypsdiave wesngqpenn ykttppvlds
181 dgsfflyskl tvdksrwqqg nvfscsvmhe alhnhytqks lslspgk
```

GenBank AAN76044
*Homo sapiens* IgG2 Fc (amino acids 99-325)
227 aa

```
  1 stkgpsvfpl apcsrstses taalgclvkd yfpepvtvsw nsgaltsgvh tfpavlqssg
 61 lyslssvvtv pssnfgtqty tcnvdhkpsn tkvdktverk ccvecppcpa ppvagpsvfl
121 fppkpkdtlm isrtpevtcv vvdvshedpe vqfnwyvdgv evhnaktkpr eeqfnstfrv
181 vsvltvvhqd wlngkeykck vsnkglpapi ektisktkgq prepqvytlp psreemtkng
241 vsltclvkgf ypsdiavewe sngqpennyk ttppmldsdg sfflyskltv dksrwqggnv
301 fscsvmheal hnhytqksls lspgk
```

GenBank AAW65947
*Homo sapiens* IgG3 Fc (amino acids 19-246)
238 aa

```
  1 hkpsntkvdk rvelktplgd tthtcppcpa pellggpsvf lfppkpkdtl misrtpevtc
 61 vvvdvshedp evkfnwyvdg vevhnaktkp reeqynstyr vvsvltvlhq dwlngkeykc
121 kvsnkalpap iektiskakg qprepqvytl ppsrdeltkn qvsltclvkg fypsdiavew
181 esngqpenny kttppvldsd gsfflysklt vdksrwqqgn vfscsvmhea lhnhytqksl
241 slspgk
```

FIG. 9B

GenBank AAA52770
*Homo sapiens* IgD Fc (amino acids 162-383)
222 aa

```
  1 ptkapdvfpi isgcrhpkdn spvvlaclit gyhptsvtvt wymgtqsqpq rtfpeiqrrd
 61 syymtssqls tplqqwrgge ykcvvqhtas kskkeifrwp espkaqassv ptaqpqaegs
121 lakattapat trntgrggee kkkekekeeq eeretktpec psht qplgvy lltpavqdlw
181 lrdkatftcf vvgsdlkdah ltwevagkvp tggveeglle rhsngsqsqh srtlprslw
241 nagtsvtctl nhpslppqrl malrepaaqa pvklslnlla ssdppeaasw llcevsgfsp
301 pnillmwled qrevntsgfa parpppqprs ttfwawsvlr vpappsppqa tytcvvshed
361 srtlnasrs levsyvtdhg pmk
```

GenBank O3082221A
*Homo sapiens* IgM Fc
276 aa

```
  1 vtstltikzs dwlgesmftc rvdhrgltfq qnassmcvpd qdtairvfai ppsfasiflt
 61 kstkltclvt dlttybsvti swtreengav kthtnisesh pnatfsavge asicedbdws
121 gerftctvth tdlpsplkqt isrpkgvalh rpbvyllppa rzzlnlresa titclvtgfs
181 padvfvewmq rgeplspqky vtsapmpepg apgryfahsi ltvseeewnt ggtytcvvah
241 ealpnrvter tvdkstgkpt lynvslvmsd tagtcy
```

FIG. 9C

GenBank P01876
*Homo sapiens* IgA Fc (amino acids 120-353)
234 aa

```
  1 asptspkvfp lslcstqpdg nvviaclvqg ffpqeplsvt wsesgqgvta rnfppsqdas
 61 gdlyttssql tlpatqclag ksvtchvkhy tnpsqdvtvp cpvpstpptp spstpptpsp
121 sschprlslh rpaledlllg seanltctlt glrdasgvtf twpssgksa vqgpperdlc
181 gcysvssvlp gcaepwnhgk tftctaaype sktpltatls ksgntfrpev hlpppseel
241 alnelvtltc largfspkdv lvrwlggsqe lprekyltwa srqepsggtt tfavtsilrv
301 aaedwkkgdt fscmvghal plaftqktid rlagkpthvn vsvmaevdg tcy
```

GenBank 1F6A_B
*Homo sapiens* IgE Fc (amino acids 6-222)
212 aa

```
  1 adpcdsnprg vsaylsrpsp fdlfirkspt itclvvdlap skgtvnltws rasgkpvnhs
 61 trkeekqrng tltvtstlpv gtrdwieget yqcrvthphl pralmrsttk tsgpraapev
121 yafatpewpg srdkrtlacl iqnfmpedis vqwlhnevql pdarhsttqp rktkgsgffv
181 fsrlevtrae weqkdeficr avheaaspsq tvqravsvnp gk
```

GenBank P01861
*Homo sapiens* IgG4 Fc (amino acids 100-327)
228 aa

```
  1 astkgpsvfp lapcsrstse staalgclvk dyfpepvtvs wnsgaltsgv htfpavlqss
 61 glyslssvvt vpsssslgtkt ytcnvdhkps ntkvdkrves kygppcpscp apeflggpsv
121 flfppkpkdt lmisrtpevt cvvvdvsqed pevqfnwyvd gvevhnaktk preeqfnsty
181 rvvsvltvlh qdwlngkeyk ckvsnkglps siektiskak gqprepqvyt lppsqeemtk
241 nqvsltclvk gfypsdiave wesngqpenn ykttppvlds dgsfflysrl tvdksrwqeg
301 nvfscsvmhe alhnhytqks lslslgk
```

FIG. 10

Table 1. Conserved Regions based on the conserved CD4 epitopes

| No. | Residues* | Length | Sequence | Genotype Conservancy | # of included Epitopes |
|---|---|---|---|---|---|
| CD4-R1 | 1251-1265 | 15 | VLVLNPSVAATLGFG | HCV1a, 1b, 2a, 2b, 3, 4, 5, 6, 7 | 2 |
| CD4-R2 | 1295-1309 | 15 | TYGKFLADGGCSGGA | HCV1a, 1b, 3, 4, 5, 6, 7 | 2 |
| CD4-R3 | 1387-1401 | 15 | GGRHLIFCHSKKKCD | HCV1a, 1b, 2a, 2b, 3, 4, 5, 6, 7 | 4 |
| CD4-R4 | 1415-1425 | 11 | VAYYRGLDVSV | HCV1a, 1b, 2b, 3, 4, 7 | 4 |
| CD4-R5 | 1436-1453 | 18 | ATDALMTGFTGDFDSVID | HCV1a, 1b, 3, 4, 7 | 2 |
| CD4-R6 | 1563-1577 | 15 | TGLTHIDAHFLSQTK | HCV1a, 1b, 2a, 2b, 3, 7 | 1 |
| CD4-R7 | 1773-1785 | 13 | QYLAGLSTLPGNP | HCV1a, 1b, 2a, 2b, 3, 4, 5, 6, 7 | 4 |
| CD4-R8 | 1881-1888 | 8 | NLLPAILS | HCV1a, 1b, 2b, 3, 4, 7 | 1 |
| CD4-R9 | 1904-1930 | 27 | RHVGPGEGAVQWMNRLIAFASRGNHVS | HCV1a, 1b, 3, 4 | 3 |
| CD4-R10 | 2201-2215 | 15 | SSASQLSAPSLKATC | HCV1a, 1b, 2b, 3, 4, 5, 6 | 1 |
| CD4-R11 | 2788-2792 | 5 | SNVSV | HCV1a, 1b, 2a, 2b, 3, 4, 5, 6, 7 | 1 |

* Numbers are based on HCV1a genotype sequence. R = region

FIG. 11

Table 2. Number of located HCV CD8 T cell epitopes and anchor positions for common each MHC-I Alleles in USA

| MHC-I Allele | Total Epitopes (#) | Located Epitopes (#) | Allele-specific Anchor Positions | | |
|---|---|---|---|---|---|
| | | | 2 | 9 | Others |
| A*02:01 | 48 | 29 | M#, L, Q, V, I | V, L, I, A, M | F (1, 3, 7) |
| A*24:02 | 33 | 20 | Y, W, F | F, I, W, L, M | F, W (7) |
| A*03:01 | 10 | 6 | M, L, I, V, T, S, Q, A | K, Y, R | F & Y (3), K & R (1) |
| A*01:01 | 4 | 3 | T, S, A, V, M, I, L | Y, F | D (3) |
| B*35:01 | 1 | 1 | P, G, A | Y, M, F, H | M (1), A (8), W (1), F (1), Y (1), P (8) |
| | | | 5 | 9 | Others |
| B*08:01 | 2 | 1 | R, K, H, F | L, M, I, F, V, A, W | K (3), R (3), L (2), F (6), M (1, 2, 3), P (2), S (8) |
| | | | 1 | 2 | Others |
| B*40:02 | 2 | 2 | Y, K, R, A, H, W, G, F, Q, L, S, C, I, T, M, V | E, D | F (3), P (8), A (8) |
| C*03:03 | 2 | 2 | NA## | NA | NA |
| A*33:03 | 1 | 0 | - | - | - |
| A*02:06 | 1 | 0 | - | - | - |
| A*26:01 | 1 | 0 | - | - | - |
| A*31:01 | 1 | 0 | - | - | - |
| Total | 106 | 64 | | | |

Bold Anchor positions describe the optimal amino acid for that location. ## Not Available

FIG. 12

Table 3. Conserved Regions based on the conserved CD8 Epitopes

| No. | Residues* | Length | Sequence | Conserved HCV1a, 1b, & 3 | Conserved 9** Genotypes | # of epitopes |
|---|---|---|---|---|---|---|
| CD8-R1 | 1292-1300 | 9 | TYSTYGKFL | Yes | Yes | 2 |
| CD8-R2 | 1391-1399 | 9 | LIFCHSKKK | Yes | Yes | 2 |
| CD8-R3 | 1436-1451 | 16 | ATDALMTGFTGDFDSV | Yes | No | 2 |
| CD8-R4 | 1666-1675 | 10 | VLAALAAYCL | Yes | No | 1 |
| CD8-R5 | 1851-1859 | 9 | ILAGYGAGV | Yes | No | 1 |
| CD8-R6 | 1373-1380 | 8 | IPFYGKAI | Yes | No | 1 |
| CD8-R7 | 1596-1604 | 9 | RAQAPPPSW | Yes | No | 1 |
| CD8-R8 | 1910-1945 | 36 | EGAVQWMNRLIAFASRGN HVSPTHYVPESDAAARVT | Yes | No | 3 |
| CD8-R9 | 2290-2298 | 9 | RPDYNPPLL | Yes | No | 1 |
| CD8-R10 | 2557-2565 | 9 | TIMAKNEVF | Yes | Yes | 1 |

* Numbers are based on HCV1a genotype sequence.

** Nine genotypes include HCV1a, 1b, 2a, 2b, 3, 4, 5, 6, and 7

FIG. 13A. CD4 and CD8 epitopes for Core, P7, and NS2 regions

| Name | Type of epitope | Start* | End* |
|---|---|---|---|
| Core-1 | CD4 | 1 | 20 |
| Core-2 | CD4 | 11 | 30 |
| Core-3 | CD4 | 21 | 40 |
| Core-4 | CD4 | 39 | 63 |
| Core-5 | CD4 | 47 | 70 |
| Core-6 | CD4 | 61 | 80 |
| Core-7 | CD4 | 71 | 90 |
| Core-8 | CD4 | 81 | 100 |
| Core-9 | CD4 | 91 | 110 |
| Core-10 | CD4 | 101 | 115 |
| Core-11 | CD4 | 111 | 130 |
| Core-12 | CD4 | 125 | 139 |
| Core-13 | CD4 | 131 | 150 |
| Core-14 | CD4 | 151 | 170 |
| Core-15 | CD4 | 161 | 180 |
| Core-16 | CD8 | 35 | 44 |
| Core-17 | CD8 | 43 | 51 |
| Core-18 | CD8 | 51 | 59 |
| Core-19 | CD8 | 129 | 137 |
| Core-20 | CD8 | 131 | 140 |
| Core-21 | CD8 | 150 | 158 |
| Core-22 | CD8 | 154 | 162 |
| Core-23 | CD8 | 168 | 176 |
| Core-24 | CD8 | 177 | 187 |
| Core-25 | CD8 | 178 | 187 |
| P7-1 | CD8 | 803 | 811 |
| NS2-1 | CD4 | 955 | 974 |
| NS2-2 | CD4 | 975 | 994 |
| NS2-3 | CD4 | 985 | 1,004 |
| NS2-4 | CD4 | 1,015 | 1,034 |
| NS2-5 | CD4 | 1,035 | 1,054 |
| NS2-6 | CD8 | 924 | 933 |
| NS2-7 | CD8 | 961 | 970 |
| NS2-8 | CD8 | 989 | 997 |

* Start and End numbers are based on sequence designated "Consensus" in Fig. 16A-16L.

FIG. 13B. CD4 and CD8 epitopes that are conserved among genotypes
1a, 1b, 2a, 2b, and 3

| Name | Type of epitope | Start* | End* |
|---|---|---|---|
| NS3-1 | CD4 | 1,265 | 1,279 |
| NS3-2 | CD4 | 1,309 | 1,323 |
| NS3-3 | CD4 | 1,401 | 1,415 |
| NS3-4 | CD4 | 1,402 | 1,412 |
| NS3-5 | CD4 | 1,429 | 1,439 |
| NS3-6 | CD4 | 1,450 | 1,464 |
| NS3-7 | CD4 | 1,453 | 1,467 |
| NS3-8 | CD4 | 1,577 | 1,591 |
| NS3-9 | CD8 | 1,306 | 1,314 |
| NS3-10 | CD8 | 1,387 | 1,394 |
| NS3-11 | CD8 | 1,405 | 1,413 |
| NS3-12 | CD8 | 1,450 | 1,458 |
| NS3-13 | CD8 | 1,457 | 1,465 |
| NS3-14 | CD8 | 1,610 | 1,618 |
| NS4a-1 | CD8 | 1,683 | 1,692 |
| NS4b-1 | CD4 | 1,790 | 1,801 |
| NS4b-2 | CD4 | 1,792 | 1,802 |
| NS4b-3 | CD4 | 1,898 | 1,905 |
| NS4b-4 | CD4 | 1,921 | 1,935 |
| NS4b-5 | CD4 | 1,922 | 1,941 |
| NS4b-6 | CD4 | 1,928 | 1,947 |
| NS4b-7 | CD8 | 1,868 | 1,876 |
| NS4b-8 | CD8 | 1,927 | 1,942 |
| NS4b-9 | CD8 | 1,932 | 1,940 |
| NS4b-10 | CD8 | 1,948 | 1,962 |
| NS5a-1 | CD4 | 2,218 | 2,232 |
| NS5a-2 | CD8 | 2,309 | 2,317 |
| NS5b-1 | CD4 | 2,847 | 2,851 |
| NS5b-2 | CD8 | 2,602 | 2,610 |

* Start and End numbers are based on sequence designated "Consensus" in Fig. 16A-16L.

FIG. 14A

| Name | Sequence* | Start** | End** | Contained Epitopes |
|---|---|---|---|---|
| TP29 | AIPLEVIKGGRHLIFCHSKKKCDELAAKL | 1,393 | 1,421 | NS3-3, NS3-4, NS3-11 |
| TP50 | LGALTGTYVYNHLTPLRDWAHNGLRDLAVAVEPVVFSQMETKLITWGADT | 955 | 1,004 | NS2-1, NS2-2, NS2-3, NS2-7, NS2-8 |
| TP52 | AIPLEVIKGGRHLIFCHSKKKCDELAAKLVALGINAVAYYRGLDVSVIPTSG | 1,393 | 1,444 | NS3-3, NS3-4, NS3-5, NS3-11 |
| TP70 | KGGRHLIFCHSKKKCDELAAKLVALGINAVAYYRGLDVSVIPTSGDVVVVATDALMTGFTGDFDSVIDCN | 1,400 | 1,469 | NS3-3, NS3-4, NS3-5, NS3-6, NS3-7, NS3-11, NS3-12, NS3-13 |
| TP100 | VALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDF | 1,379 | 1,478 | NS3-3, NS3-4, NS3-5, NS3-6, NS3-7, NS3-10, NS3-11, NS3-12, NS3-13 |
| TP171 | MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPG | 1 | 171 | Core-1, Core-2, Core-3, Core-4, Core-5, Core-6, Core-7, Core-8, Core-9, Core-10, Core-11, Core-12, Core-13, Core-14, Core-16, Core-17, Core-18, Core-19, Core-20, Core-21, Core-22 |
| TP228 | LHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCN | 1,242 | 1,469 | NS3-1, NS3-2, NS3-3, NS3-4, NS3-5, NS3-6, NS3-7, NS3-9, NS3-10, NS3-11, NS3-12, NS3-13 |
| TP553 | QASLLKVPYFVRVQGLLRICALARKMAGGHYVQMAIIKLGALTGTYVYNALTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDSRGSLLSPRPISYLKGSAGGPLLCPAGHAVGIFRAAVCTRGVAKAVDFIPVENLETTMRSPVFTDNSSPPAVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGK | 917 | 1,469 | NS2-1, NS2-2, NS2-3, NS2-4, NS2-5, NS2-6, NS2-7, NS2-8, NS3-1, NS3-2, NS3-3, NS3-4, NS3-5, NS3-6, NS3-7, NS3-9, NS3-10, NS3-11, NS3-12, NS3-13 |

FIG. 14B

| | | | | |
|---|---|---|---|---|
| | AIPLEVIKGGRHLIFCHSKKKCDELAAKLV ALGINAVAYYRGLDVSVIPTSGDVVVVAT DALMTGFTGDFDSVIDCN | | | |
| TP778 | LHAPTGSGKSTKVPAAYAAQGYKVLVLNP SVAATLGFGAYMSKAHGIDPNIRTGVRTIT TGSPITYSTYGKFLADGGCSGGAYDIIICDE CHSTDATSILGIGTVLDQAETAGARLVVLA TATPPGSVTVPHPNIEEVALSTTGEIPFYGK AIPLEVIKGGRHLIFCHSKKKCDELAAKLV ALGINAVAYYRGLDVSVIPTSGDVVVVAT DALMTGFTGDFDSVIDCNTCVTQTVDFSL DPTFTIETTTLPQDAVSRTQRRGRTGRGKP GIYRFVAPGERPSGMFDSSVLCECYDAGCA WYELTPAETTVRLRAYMNTPGLPVCQDHL EFWEGVFTGLTHIDAHFLSQTKQSGENLPY LVAYQATVCARAQAPPPSWDQMWKCLIR LKPTLHGPTPLLYRLGAVQNEVTLTHPITK YIMTCMSADLEVVTSTWVLVGGVLAALA AYCLSTGCVVIVGRIVLSGKPAIIPDREVLY REFDEMEECSQHLPYIEQGMMLAEQFKQK ALGLLQTASRQAEVIAPAVQTNWQKLEAF WAKHMWNFISGIQYLAGLSTLPGNPAIASL MAFTAAVTSPLTTSQTLLFNILGGWVAAQ LAAPGAATAFVGAGLAGAAIGSVGLGKVL VDILAGYGAGVAGALVAFKIMSGEVPSTE DLVNLLPAILSPGALVVGVVCAAILRRHVG PGEGAVQWMNRLIAFASRGNHVSPTHYVP ESDAAARVTAILSSLTVTQLLRRLHQWISS ECTTPCSGSWLRDIWDWICEVLSDFKTWL KAKLMPQLPG | 1,242 | 2,022 | NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10 |

FIG. 14C

| TP1985 | APITAYAQQTRGLLGCIITSLTGRDKNQVE GEVQIVSTAAQTFLATCINGVCWTVYHGA GTRTIASPKGPVIQMYTNVDQDLVGWPAP QGARSLTPCTCGSSDLYLVTRHADVIPVRR RGDSRGSLLSPRPISYLKGS<u>A</u>GGPLLCPAG HAVGIFRAAVCTRGVAKAVDFIPVENLETT MRSPVFTDNSSPPAVPQSFQVAHLHAPTGS GKSTKVPAAYAAQGYKVLVLNPSVAATL GFGAYMSKAHGIDPNIRTGVRTITTGSPITY STYGKFLADGGCSGGAYDIIICDECHSTDA TSILGIGTVLDQAETAGARLVVLATATPPG SVTVPHPNIEEVALSTTGEIPFYGKAIPLEVI KGGRHLIFCHSKKKCDELAAKLVALGINA VAYYRGLDVSVIPTSGDVVVVATDALMTG FTGDFDSVIDCNTCVTQTVDFSLDPTFTIET TTLPQDAVSRTQRRGRTGRGKPGIYRFVAP GERPSGMFDSSVLCECYDAGCAWYELTPA ETTVRLRAYMNTPGLPVCQDHLEFWEGVF TGLTHIDAHFLSQTKQSGENLPYLVAYQAT VCARAQAPPPSWDQMWKCLIRLKPTLHGP TPLLYRLGAVQNEVTLTHPITKYIMTCMSA DLEVVTSTWVLVGGVLAALAAYCLSTGC VVIVGRIVLSGKPAIIPDREVLYREFDEMEE CSQHLPYIEQGMMLAEQFKQKALGLLQTA SRQAEVIAPAVQTNWQKLEAFWAKHMWN FISGIQYLAGLSTLPGNPAIASLMAFTAAVT SPLTTSQTLLFNILGGWVAAQLAAPGAATA FVGAGLAGAAIGSVGLGKVLVDILAGYGA GVAGALVAFKIMSGEVPSTEDLVNLLPAIL SPGALVVGVVCAAILRRHVGPGEGAVQW MNRLIAFASRGNHVSPTHYVPESDAAARV TAILSSLTVTQLLRRLHQWISSECTTPCSGS WLRDIWDWICEVLSDFKTWLKAKLMPQLP GIPFVSCQRGYRGVWRGDGIMHTRCHCGA EITGHVKNGTMRIVGPRTCRNMWSGTFPIN AYTTGPCTPLPAPNYTFALWRVSAEEYVEI RQVGDFHYVTGMTTDNLKCPCQVPSPEFF TELDGVRLHRFAPPCKPLLREEVSFRVGLH EYPVGSQLPCEPEPDVAVLTSMLTDPSHIT AEAAGRRLARGSPPSVASSSASQLSAPSLK ATCTANHDSPDAELIEANLLWRQEMGGNI TRVESENKVVILDSFDPLVAEEDEREISVPA EILRKSRRFAPALPIWARPDYNPPLLETWK KPDYEPPVVHGCPLPPPQSPPVPPPRKKRT VVLTESTVSTALAELATKSFGSSSTSGITGD NTTTSSEPAPSGCPPDSDAESYSSMPPLEGE | 1041 | 3073 | NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10, NS5a-1, NS5a-2, NS5b-1, NS5b-2 |

FIG. 14D

| | PGDPDLSDGSWSTVSSEADTEDVVCCSMS YSWTGALVTPCAAEEQKLPINALSNSLLRH HNLVYSTTSRSACQRQKKVTFDRLQVLDS HYQDVLKEVKAAASKVKANLLSVEEACSL TPPHSAKSKFGYGAKDVRCHARKAVNHIN SVWKDLLEDSVTPIDTTIMAKNEVFCVQPE KGGRKPARLIVFPDLGVRVCEKMALYDVV SKLPLAVMGSSYGFQYSPGQRVEFLVQAW KSKKTPMGFSYDTRCFDSTVTESDIRTEEAI YQCCDLDPQARVAIKSLTERLYVGGPLTNS RGENCGYRRCRASGVLTTSCGNTLTCYIK ARAACRAAGLQDCTMLVCG<u>NN</u>LVVICESA GVQEDAASLRAFTEAMTRYSAPPGDPPQP EYDLELITSCSSNVSVAHDGAGKRVYYLTR DPTTPLARAAWETARHTPVNSWLGNIIMF APTLWARMILMTHFFSVLIARDQLEQALD CEIYGACYSIEPLDLPPIIQRLHGLSAFSLHS YSPGEINRVAACLRKLGVPPLRAWRHRAR SVRARLLSRGGRAAICGKYLFNWAVRTKL KLTPIAAAGQLDLSGWFTAGYSGGDIYHS VSHARPRWFWFCLLLLAAGVGIYLLPNR | | |

\* TP sequences are based on HCV1a consensus sequence and gaps were removed
\*\* Start and End numbers are based on sequence designated "Consensus" in Fig. 16A-16L.

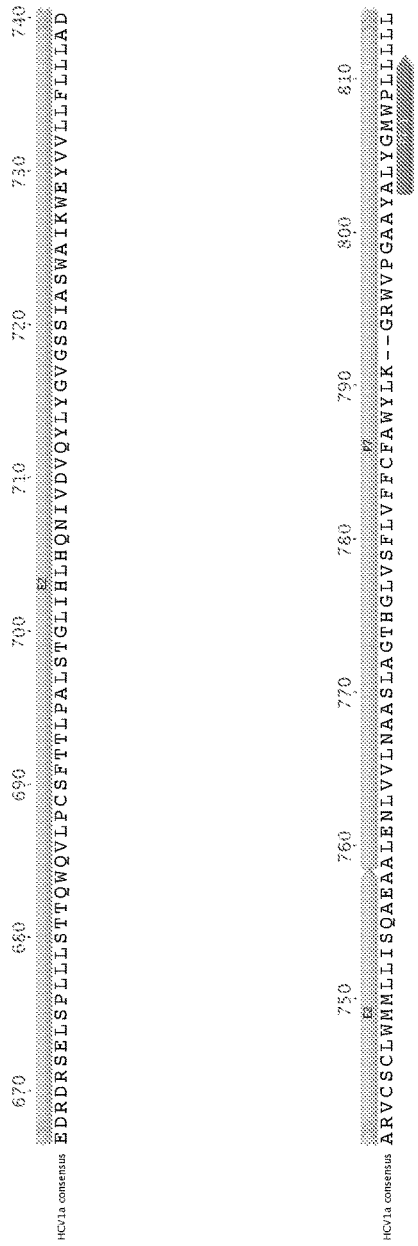
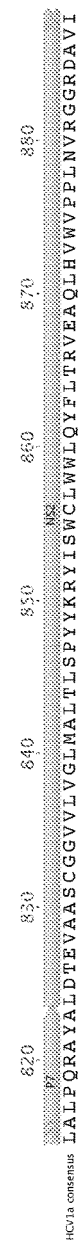
FIG. 15D

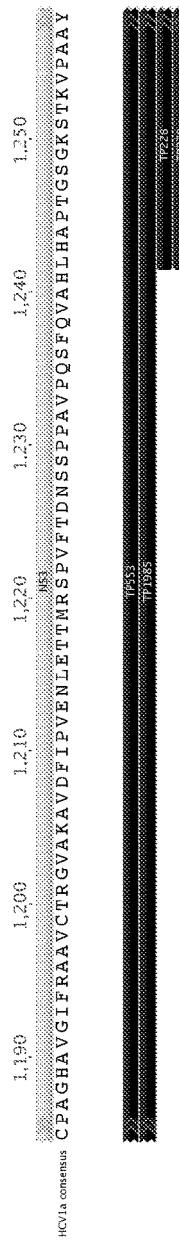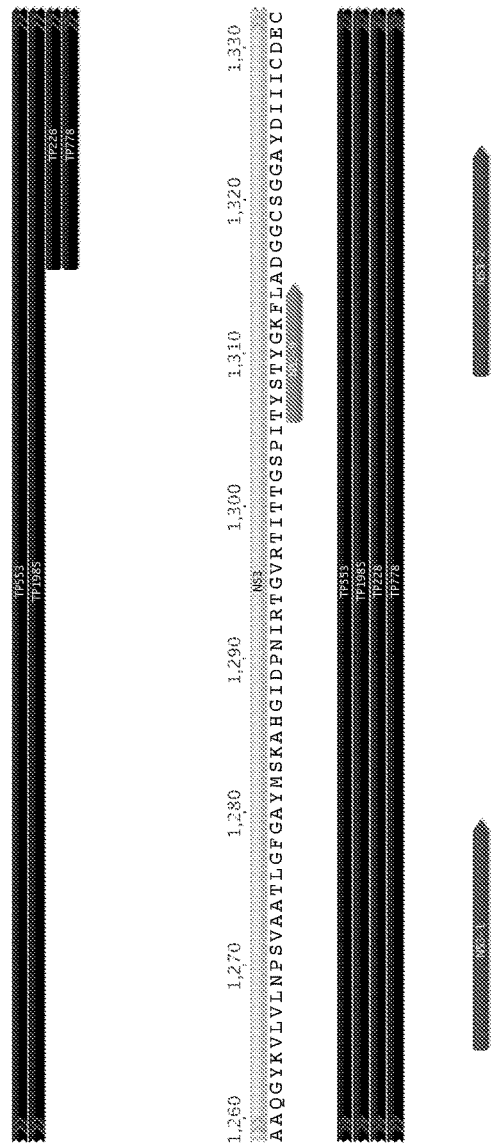
FIG. 15F

HCV1a consensus DWICEVLSDFKTWLKAKLMPQLPGIPFVSCQRGYRGVWRGDGIMHTRCHCGAEITGHVKNGTMRIVGPRTCRNM HCV1a consensus WSGTFPINAYTTGPCTPLPAPNYTFALWRVSAEE HCV1a consensus  -----GSWSTVSSEADTEDVVCCSMSYSWTGALVTPCAAEEQKLPINALSNSLLRHHNLVYSTTSRSACQRQKK HCV1a consensus  VTFDRLQVLDSHYQDVLKEVKAAASKVKANLLSVEEACSLTPPHSAKSKFGYGAKDVRCHARKAVNHINSVWKD HCV1a consensus  LLEDSVTPIDTTIMAKNEVFCVQPEKGGRKPARLIVFPDL-GVRVCEKMALYDVVSKLPLAVMGSSYGFQYSPG

FIG. 15L

HCV1a consensus VNSWLGNIIMFAPTLWARMILMTHFFSVLIARDQLEQALDCEIYGACYSIEPLDLPPIIQRLHGLSAFSLHSYS HCV1a consensus PGEINRVAACLRKLGVPPLRAWRHRARSVRARLLSRGG

HEPATITIS C VIRUS IMMUNOGENIC COMPOSITIONS AND METHODS OF USE THEREOF

CROSS-REFERENCE

This application claims the benefit of U.S. Provisional Patent Application No. 62/189,657, filed Jul. 7, 2015, which application is incorporated herein by reference in its entirety.

INCORPORATION BY REFERENCE OF SEQUENCE LISTING PROVIDED AS A TEXT FILE

A Sequence Listing is provided herewith as a text file, "UALB-027WO_Sequence_Listing_ST25.txt" created on Jul. 5, 2016 and having a size of 933 KB. The contents of the text file are incorporated by reference herein in their entirety.

INTRODUCTION

Hepatitis C virus (HCV) is a blood-borne pathogen that is estimated to infect 150-200 million people worldwide. Infection by HCV may be non-symptomatic, and can be cleared by patients, sometimes without medical intervention. However, the majority of patients develop a chronic HCV infection, which may lead to liver inflammation, scarring, and even to liver failure or liver cancer. In the United States alone, over 3 million people have a chronic infection.

The HCV virion contains a positive-sense single stranded RNA genome of about 9.5 kb. The genome encodes a single polyprotein of 3,010 to 3,030 amino acids. The structural proteins comprise a core protein forming the viral nucleocapsid and two envelope glycoproteins, E1 and E2.

A vaccine based on the recombinant envelope glycoproteins (rE1E2) from a single genotype 1a strain (HCV-1) protected chimpanzees from chronic infection following homologous and heterologous genotype 1a (gt1a) viral challenge (reviewed in Houghton, M Immunol Rev 2011). Antisera from the immunized chimpanzees were shown to exhibit in vitro cross-neutralizing activity (Meunier et al. (2011) *J. Infect. Dis.* 204:1186). A phase I clinical trial was conducted in human volunteers with a similar antigen (Frey et al. (2010) *Vaccine* 28:6367). Antisera from selected vaccinated individuals were similarly capable of neutralizing chimeric cell culture-derived viruses (HCVcc) expressing the structural proteins of strains representing all 7 major HCV genotypes in vitro (Law et al. (2013) *PLoS One* 8:e59776) and to be able to compete with the binding of numerous discrete monoclonal antibodies with broad crossneutralising activities (Wong et al. (2014) *J. Virol.* 88:14278).

There is a need in the art for compositions and methods for inducing immune responses to HCV.

SUMMARY

The present disclosure provides heterodimeric polypeptides comprising a variant hepatitis C virus (HCV) E2 polypeptide and an HCV E1 polypeptide, or comprising a variant HCV E1 polypeptide and an HCV E2 polypeptide, or comprising a variant HCV E1 polypeptide and a variant HCV E2 polypeptide, where the variant HCV E2 polypeptide and/or the variant HCV E1 polypeptide comprises one or more T cell epitopes, e.g., one or more T cell epitopes present in an HCV polypeptide other than an HCV E1 polypeptide or an HCV E2 polypeptide. The present disclosure provides nucleic acids encoding a polyprotein that includes E1 and variant E2, or that includes E2 and variant E1, or that includes variant E2 and variant E1. The present disclosure provides a method of producing an E1/E2 heterodimer of the present disclosure. The present disclosure provides a method of inducing an immune response in an individual. The present disclosure provides variant E2 polypeptides and variant E1 polypeptides; and nucleic acids encoding the variant polypeptides.

The present disclosure provides a heterodimeric polypeptide comprising: a) a variant HCV E2 polypeptide comprising: i) an HCV E2 polypeptide; and ii) a heterologous polypeptide comprising a T-cell epitope present in an HCV protein other than E1 and E2; and b) an HCV E1 polypeptide. In some cases, the heterologous polypeptide comprises one or more T cell epitopes present in one or more of: a) an HCV non-structural polypeptide-3 (NS3) polypeptide; b) an HCV non-structural polypeptide-2 (NS2) polypeptide; c) an HCV non-structural polypeptide-4A (NS4A) polypeptide; d) an HCV non-structural polypeptide-4B (NS4B) polypeptide; e) an HCV non-structural polypeptide-5A (NS5A) polypeptide; f) an HCV non-structural polypeptide-5B (NS5B) polypeptide; g) an HCV core polypeptide; and h) an HCV p7 polypeptide. In some cases, a) the HCV E2 polypeptide is derived from an HCV of genotype 1, 2, 3, or 7; and b) the HCV E1 polypeptide is derived from an HCV of genotype 1, 2, 3, or 7. In some cases, the HCV E2 polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an E2 polypeptide depicted in one of FIGS. 1A-1C, FIGS. 2A-2C, FIGS. 3A-3C, and FIGS. 4A-4B. In some cases, the heterologous polypeptide has a length of from about 10 amino acids to about 3000 amino acids. In some cases the heterologous polypeptide has a length of from about 10 amino acids to about 100 amino acids. In some cases the heterologous polypeptide comprises one or more T cell epitopes present in an HCV NS3 polypeptide. In some cases, the heterologous polypeptide comprises an amino acid sequence having at least 20% amino acid sequence identity to the following amino acid sequence: AIPLEVIKGGRHLIFCHS-KKKCDELAAKL (SEQ ID NO:1). In some cases, the heterologous polypeptide comprises an amino acid sequence having at least 20% amino acid sequence identity to the following amino acid sequence: AIPLEVIKGGRHLIFCHS-KKKCDELAAKLVALGINAVAYYRGLDVSVIPTSG (SEQ ID NO:2). In some cases, the heterologous polypeptide comprises an amino acid sequence having at least 20% amino acid sequence identity to the following amino acid sequence: KGGRHLIFCHSKKKCDELAAKLVALGI-NAVAYYRGLDVSVIPTSGDVVVVATD ALMTGFTGD-FDSVIDCN (SEQ ID NO:3). In some cases, the heterologous polypeptide comprises an amino acid sequence having at least 20% amino acid sequence identity to the following amino acid sequence: VALSTTGEIPFYGKAIPLEVIKG-GRHLIFCHSKKKCDELAAKLVALGINAVAYYR GLD-VSVIPTSGDVVVVATDALMTGFTGDFDSVID-
CNTCVTQTVDF (SEQ ID NO:4). In some cases, the variant HCV E2 polypeptide comprises, in order from N-terminus to C-terminus: i) the heterologous polypeptide; and ii) the HCV E2 polypeptide. In some cases, the variant HCV E2 polypeptide comprises, in order from N-terminus to C-terminus: i) the HCV E2 polypeptide; and ii) the heterologous polypeptide. In some cases, the heterologous polypeptide comprises one or more T cell epitopes present in: a) cholera toxin or toxoid; and/or b) tetanus toxin or toxoid; and/or c) diphtheria toxin or toxoid; and/or d) CRM197. In some cases, the E2 polypeptide and/or the E1 polypeptide lacks a C-terminal transmembrane domain. In some cases, the modified HCV E2 polypeptide and the HCV E1 polypeptide are derived from an HCV of the same genotype. In some cases, the modified HCV E2 polypeptide and the HCV E1 polypeptide are derived from an HCV of different genotypes. In some cases, the HCV E1 polypeptide comprises an amino acid sequence having at least 20% amino acid sequence identity to an E1 polypeptide depicted in FIGS. 1A-1C, FIGS. 2A-2C, FIGS. 3A-3C, and FIGS. 4A-4B.

The present disclosure provides a nucleic acid comprising nucleotide sequences encoding any one of the heterodimeric polypeptides as described above or elsewhere herein. In some cases, the nucleotide sequence encoding the variant HCV E2 polypeptide and the nucleotide sequence encoding the HCV E1 polypeptide are operably linked to a promoter. The present disclosure provides a recombinant expression vector comprising the nucleic acid.

The present disclosure provides a heterodimeric polypeptide comprising: a) a variant HCV E1 polypeptide comprising: i) an HCV E1 polypeptide; and ii) a heterologous polypeptide comprising a T-cell epitope present in an HCV protein other than E1 and E2; and b) an HCV E2 polypeptide. In some cases, the heterologous polypeptide comprises one or more T cell epitopes present in one or more of: a) an HCV NS3 polypeptide; b) an HCV NS2 polypeptide; c) an HCV NS-4A polypeptide; d) an HCV NS4B polypeptide; e) an HCV NS5A polypeptide; f) an HCV NS5B polypeptide; g) an HCV core polypeptide; and h) an HCV p7 polypeptide. In some cases, a) the HCV E2 polypeptide is derived from an HCV of genotype 1, 2, 3, or 7; and b) the HCV E1 polypeptide is derived from an HCV of genotype 1, 2, 3, or 7. In some cases, the HCV E1 polypeptide comprises an amino acid sequence having at least 20% amino acid sequence identity to an E1 polypeptide depicted in one of FIGS. 1A-1C, FIGS. 2A-2C, FIGS. 3A-3C, and FIGS. 4A-4B. In some cases, the heterologous polypeptide has a length of from about 10 amino acids to about 3000 amino acids. In some cases, the heterologous polypeptide has a length of from about 10 amino acids to about 100 amino acids. In some cases, the heterologous polypeptide comprises one or more T cell epitopes present in an HCV NS3 polypeptide. In some cases, the heterologous polypeptide comprises an amino acid sequence having at least 20% amino acid sequence identity to the following amino acid sequence: AIPLEVIKGGRHLIFCHSKKKCDELAAKL (SEQ ID NO:1). In some cases, the heterologous polypeptide comprises an amino acid sequence having at least 20% amino acid sequence identity to the following amino acid sequence: AIPLEVIKGGRHLIFCHSKKKCDELAAK-LVALGINAVAYYRGLDVSVIPTSG (SEQ ID NO:2). In some cases, the heterologous polypeptide comprises an amino acid sequence having at least 20% amino acid sequence identity to the following amino acid sequence: KGGRHLIFCHSKKKCDELAAKLVALGINAVAYYR-GLDVSVIPTSGDVVVATD ALMTGFTGDFDSVIDCN (SEQ ID NO:3). In some cases, the heterologous polypeptide comprises an amino acid sequence having at least 20% amino acid sequence identity to the following amino acid sequence: VALSTTGEIPFYGKAIPLEVIKGGRHLIFCHS-KKKCDELAAKLVALGINAVAYYR GLDVSVIPTSGDV-VVVATDALMTGFTGDFDSVIDCNTCVTQTVDF (SEQ ID NO:4). In some cases, the variant HCV E1 polypeptide comprises, in order from N-terminus to C-terminus: i) the heterologous polypeptide; and ii) the HCV E1 polypeptide. In some cases, the variant HCV E1 polypeptide comprises, in order from N-terminus to C-terminus: i) the HCV E1 polypeptide; and ii) the heterologous polypeptide. In some cases, the heterologous polypeptide comprises one or more T cell epitopes present in: a) cholera toxin or toxoid; and/or b) tetanus toxin or toxoid; and/or c) diphtheria toxin or toxoid; and/or d) CRM197. In some cases, the E2 polypeptide and/or the E1 polypeptide lacks a C-terminal transmembrane domain. In some cases, the modified HCV E2 polypeptide and the HCV E1 polypeptide are derived from an HCV of the same genotype. In some cases, the modified HCV E2 polypeptide and the HCV E1 polypeptide are derived from an HCV of different genotypes. In some cases, the HCV E2 polypeptide comprises an amino acid sequence having at least 20% amino acid sequence identity to an E2 polypeptide depicted in FIGS. 1A-1C, FIGS. 2A-2C, FIGS. 3A-3C, and FIGS. 4A-4B.

The present disclosure provides nucleic acid comprising nucleotide sequences encoding any one of the heterodimeric polypeptides described above or elsewhere herein. In some cases, the nucleotide sequence encoding the variant HCV E2 polypeptide and the nucleotide sequence encoding the HCV E1 polypeptide are operably linked to a promoter. The present disclosure provides a recombinant expression vector comprising the nucleic acid.

The present disclosure provides a heterodimeric polypeptide comprising: a) a variant HCV E1 polypeptide comprising: i) an HCV E1 polypeptide; and ii) a first heterologous polypeptide comprising a T-cell epitope present in an HCV protein other than E1 and E2; and b) a variant HCV E2 polypeptide comprising: i) an HCV E2 polypeptide; and ii) a second heterologous polypeptide comprising a T-cell epitope present in an HCV protein other than E1 and E2. In some cases, the first and the second heterologous polypeptides comprise one or more T cell epitopes present in one or more of: a) an HCV NS3 polypeptide; b) an HCV NS2 polypeptide; c) an HCV NS-4A polypeptide; d) an HCV NS4B polypeptide; e) an HCV NS5A polypeptide; f) an HCV NS5B polypeptide; g) an HCV core polypeptide; and h) an HCV p7 polypeptide. In some cases, a) the HCV E2 polypeptide is derived from an HCV of genotype 1, 2, 3, or 7; and b) the HCV E1 polypeptide is derived from an HCV of genotype 1, 2, 3, or 7. In some cases, the HCV E1 polypeptide comprises an amino acid sequence having at least 20% amino acid sequence identity to an E1 polypeptide depicted in one of FIGS. 1A-1C, FIGS. 2A-2C, FIGS. 3A-3C, and FIGS. 4A-4B. In some cases, each of the first and the second heterologous polypeptide independently has a length of from about 10 amino acids to about 3000 amino acids. In some cases, each of the first and the second heterologous polypeptide independently has a length of from about 10 amino acids to about 100 amino acids. In some cases, the first and/or the second heterologous polypeptide comprises one or more T cell epitopes present in an HCV NS3 polypeptide. In some cases, the first and/or the second heterologous polypeptide comprises an amino acid sequence having at least 20% amino acid sequence identity to the following amino acid sequence: AIPLEVIKGGRHLIFCHS-KKKCDELAAKL (SEQ ID NO:1). In some cases, the first and/or the second heterologous polypeptide comprises an amino acid sequence having at least 20% amino acid sequence identity to the following amino acid sequence: AIPLEVIKGGRHLIFCHSKKKCDELAAKLVALGI-NAVAYYRGLDVSVIPTSG (SEQ ID NO:2). In some cases, the first and/or the second heterologous polypeptide comprises an amino acid sequence having at least 20% amino acid sequence identity to the following amino acid sequence: KGGRHLIFCHSKKKCDELAAKLVALGI-NAVAYYRGLDVSVIPTSGDVVVVATD ALMTGFTGD-FDSVIDCN (SEQ ID NO:3). In some cases, the first and/or the second heterologous polypeptide comprises an amino acid sequence having at least 20% amino acid sequence identity to the following amino acid sequence: VALSTT-GEIPFYGKAIPLEVIKGGRHLIFCHSKKKCDELAAK-LVALGINAVAYYR GLDVSVIPTSGDVVVVATDALMT-GFTGDFDSVIDCNTCVTQTVDF (SEQ ID NO:4). In some cases, the variant HCV E1 polypeptide comprises, in order from N-terminus to C-terminus: i) the heterologous polypeptide; and ii) the HCV E1 polypeptide, and wherein the variant HCV E2 polypeptide comprises, in order from N-terminus to C-terminus: i) the heterologous polypeptide; and ii) the HCV E2 polypeptide. In some cases, the variant HCV E1 polypeptide comprises, in order from N-terminus to C-terminus: i) the HCV E1 polypeptide; and ii) the heterologous polypeptide, and wherein the variant HCV E2 polypeptide comprises, in order from N-terminus to C-terminus: i) the HCV E2 polypeptide; and ii) the heterologous polypeptide. In some cases, the first and/or the second heterologous polypeptide comprises one or more T cell epitopes present in: a) cholera toxin or toxoid; and/or b) tetanus toxin or toxoid; and/or c) diphtheria toxin or toxoid; and/or d) CRM197. In some cases, the E2 polypeptide and/or the E1 polypeptide lacks a C-terminal transmembrane domain. In some cases, the modified HCV E2 polypeptide and the HCV E1 polypeptide are derived from an HCV of the same genotype. In some cases, the modified HCV E2 polypeptide and the HCV E1 polypeptide are derived from an HCV of different genotypes. In some cases, the HCV E2 polypeptide comprises an amino acid sequence having at least 20% amino acid sequence identity to an E2 polypeptide depicted in FIGS. 1A-1C, FIGS. 2A-2C, FIGS. 3A-3C, and FIGS. 4A-4B.

The present disclosure provides a nucleic acid comprising nucleotide sequences encoding any one of the heterodimeric polypeptides described above or elsewhere herein. In some cases, the nucleotide sequence encoding the variant HCV E2 polypeptide and the nucleotide sequence encoding the HCV E1 polypeptide are operably linked to a promoter. The present disclosure provides a recombinant expression vector comprising the nucleic acid.

The present disclosure provides a composition comprising: a) a heterodimeric polypeptide as described above or elsewhere herein; and b) a pharmaceutically acceptable excipient. In some cases, the pharmaceutically acceptable excipient comprises an adjuvant. In some cases, the adjuvant is MF59, alum, poly(DL-lactide co-glycolide), a CpG oligonucleotide, or keyhole limpet hemocyanin.

The present disclosure provides a nucleic acid comprising a nucleotide sequence encoding an HCV E1-E2 polyprotein comprising: a) an HCV E1 polypeptide; b) an HCV E2 polypeptide; and c) a heterologous polypeptide that comprises one or more T cell epitopes present in an HCV polypeptide other than an HCV E1 polypeptide or an HCV E2 polypeptide. In some cases, the HCV E1 polypeptide comprises an amino acid sequence having at least 20% amino acid sequence identity to an E1 polypeptide depicted in FIGS. 1A-1C, FIGS. 2A-2C, FIGS. 3A-3C, and FIGS. 4A-4B. In some cases, the HCV E2 polypeptide is derived from an HCV of genotype 1, 2, 3, or 7. In some cases, the HCV E2 polypeptide comprises an amino acid sequence having at least 20% amino acid sequence identity to an E2 polypeptide depicted in FIGS. 1A-1C, FIGS. 2A-2C, FIGS. 3A-3C, and FIGS. 4A-4B. In some cases, the HCV E2 polypeptide is derived from an HCV of genotype 1, 2, 3, or 7. In some cases, the HCV E2 polypeptide and the HCV E1 polypeptide are of the same genotype. In some cases, the HCV E2 polypeptide and the HCV E1 polypeptide are of different genotypes. In some cases, the heterologous polypeptide has a length of from about 10 amino acids to about 3000 amino acids. In some cases, the heterologous polypeptide has a length of from about 10 amino acids to about 100 amino acids. In some cases, the E1-E2 polyprotein comprises, in order from N-terminus to C-terminus: i) the HCV E1 polypeptide; ii) the heterologous polypeptide; and iii) the HCV E2 polypeptide. In some cases, the E1-E2 polyprotein comprises, in order from N-terminus to C-terminus: i) the HCV E1 polypeptide; ii) the HCV E2 polypeptide; and iii) the heterologous polypeptide. In some cases, the E1-E2 polyprotein comprises, in order from N-terminus to C-terminus: i) the heterologous polypeptide; ii) the HCV E1 polypeptide; and iii) the HCV E2 polypeptide. In some cases, the E1-E2 polyprotein comprises, in order from N-terminus to C-terminus: i) the HCV E1 polypeptide; ii) the heterologous polypeptide; and iii) the HCV E2 polypeptide. In some cases, the nucleic acid comprises a nucleotide sequence encoding an immunoglobulin Fc polypeptide. In some cases, the polypeptide encoded by the nucleic acid comprises, in order from N-terminus to C-terminus: i) the E1 polypeptide; ii) the Fc polypeptide; iii) the heterologous polypeptide; and iv) the HCV E2 polypeptide. In some cases, the polypeptide encoded by the nucleic acid comprises a proteolytically cleavable linker interposed between the Fc polypeptide and the heterologous polypeptide. In some cases, the polypeptide encoded by the nucleic acid comprises, in order from N-terminus to C-terminus: i) the E1 polypeptide; ii) the Fc polypeptide; iii) the HCV E2 polypeptide; and iv) the heterologous polypeptide. In some cases, a proteolytically cleavable linker is interposed between the Fc polypeptide and the HCV E2 polypeptide. In some cases, a) the proteolytically cleavable linker comprises the sequence LEVLFQGP (SEQ ID NO:5), wherein cleavage occurs between the glutamine and the glycine; b) the proteolytically cleavable linker comprises the sequence ENLYTQS (SEQ ID NO:6), wherein cleavage occurs between the glutamine and the serine; c) the proteolytically cleavable linker comprises the sequence DDDDK (SEQ ID NO:7), wherein cleavage occurs immediately C-terminal to the lysine residue; or d) the proteolytically cleavable linker comprises the sequence LVPR (SEQ ID NO:8). In some cases, the heterologous polypeptide comprises one or more T cell epitopes present in one or more of: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; and h) an HCV p7 polypeptide. In some cases, the heterologous polypeptide comprises one or more T cell epitopes present in: a) cholera toxin or toxoid; and/or b) tetanus toxin or toxoid; and/or c) diphtheria toxin or toxoid; and/or d) CRM197. In some cases, the heterologous polypeptide comprises one or more T cell epitopes present in an HCV NS3 polypeptide. In some cases, the heterologous polypeptide comprises an amino acid sequence having at least 20% amino acid sequence identity to the following amino acid sequence: AIPLEVIKGGRHLIFCHSKKKCDELAAKL (SEQ ID NO:1). In some cases, the heterologous polypeptide comprises an amino acid sequence having at least 20% amino acid sequence identity to the following amino acid sequence: AIPLEVIKGGRHLIFCHSKKKCDELAAKLVALGINAVAYYRGLDVSVIPTSG (SEQ ID NO:2). In some cases, the heterologous polypeptide comprises an amino acid sequence having at least 20% amino acid sequence identity to the following amino acid sequence: KGGRHLIFCHSKKKCDELAAKLVALGI-NAVAYYRGLDVSVIPTSGDVVVVATD ALMTGFTGD-FDSVIDCN (SEQ ID NO:3). In some cases, the heterologous polypeptide comprises an amino acid sequence having at least 20% amino acid sequence identity to the following amino acid sequence:

(SEQ ID NO: 4)
VALSTTGEIPFYGKAIPLEVIKGGRHLIFCHSKKKCDELAAKLVALGIN
AVAYYRGLDVSVIPTSGDVVVVATDALMTGFTGDFDSVIDCNTCVTQTV
DF.

The present disclosure provides a recombinant expression vector comprising a nucleic acid as described above or elsewhere herein. In some cases, the nucleotide sequence is operably linked to a promoter. In some cases, the promoter is functional in a eukaryotic cell. The present disclosure provides a genetically modified in vitro host cell comprising a nucleic acid as described above or elsewhere herein, or the recombinant vector. In some cases, the host cell is a eukaryotic cell. In some cases, the host cell is a mammalian cell.

The present disclosure provides a method of making a variant HCV E1-E2 heterodimer, the method comprising: a) contacting a lysate of a genetically modified host cell described above, or elsewhere herein, with an Fc-binding polypeptide immobilized on an insoluble support, wherein the encoded HCV E1-E2 heterodimer comprises an Fc polypeptide, and wherein the HCV E1-E2 heterodimer present in the lysate binds to the immobilized Fc-binding polypeptide, generating an immobilized HCV E1-E2 heterodimer; and b) contacting the immobilized HCV E1-E2 heterodimer with an enzyme that cleaves the proteolytic cleavage site interposed between the Fc polypeptide and the heterologous polypeptide, thereby releasing the variant HCV E1-E2 heterodimer. In some cases, the released variant HCV E1-E2 heterodimer is at least 50% pure. In some cases, the Fc binding polypeptide is Protein A, Protein G, or a Protein A/G fusion. In some cases, a) the proteolytically cleavable linker comprises the sequence LEVLFQGP (SEQ ID NO:5), wherein cleavage occurs between the glutamine and the glycine; b) the proteolytically cleavable linker comprises the sequence ENLYTQS (SEQ ID NO:6), wherein cleavage occurs between the glutamine and the serine; c) the proteolytically cleavable linker comprises the sequence DDDDK (SEQ ID NO:7), wherein cleavage occurs immediately C-terminal to the lysine residue; or d) the proteolytically cleavable linker comprises the sequence LVPR (SEQ ID NO:8). In some cases, the enzyme is human rhinovirus 3C protease, a tobacco etch virus protease, an enterokinase, or thrombin. In some cases, the method further comprises subjecting a composition comprising the released HCV E1-E2 heterodimer to hydroxyapatite chromatography. Hydroxyapatite chromatography can be carried out as described in, e.g., Mazzocca et al. (2005) *J. Biol. Chem.* 280:11329.

The present disclosure provides a variant HCV E2 polypeptide comprising: a) an HCV E2 polypeptide; and b) a heterologous polypeptide that comprises one or more T cell epitopes present in an HCV protein other than E1 and E2. In some cases, the HCV E2 polypeptide is derived from an HCV of genotype 1, 2, 3, or 7. In some cases, the HCV E2 polypeptide comprises an amino acid sequence having at least 20% amino acid sequence identity to an E2 polypeptide depicted in one of FIGS. 1A-1C, FIGS. 2A-2C, FIGS. 3A-3C, and FIGS. 4A-4B. In some cases, the heterologous polypeptide has a length of from about 10 amino acids to about 3000 amino acids. In some cases, the heterologous polypeptide has a length of from about 10 amino acids to about 100 amino acids. In some cases, wherein the heterologous polypeptide comprises one or more T cell epitopes present in one or more of: a) an HCV NS3 polypeptide; b) an HCV NS2 polypeptide; c) an HCV NS-4A polypeptide; d) an HCV NS4B polypeptide; e) an HCV NS5A polypeptide; f) an HCV NS5B polypeptide; g) an HCV core polypeptide; and h) an HCV p7 polypeptide. In some cases, the HCV E2 polypeptide lacks a C-terminal transmembrane domain. In some cases, the heterologous polypeptide comprises one or more T cell epitopes present in: a) cholera toxin or toxoid; and/or b) tetanus toxin or toxoid; and/or c) diphtheria toxin or toxoid; and/or d) CRM197. In some cases, the heterologous polypeptide comprises one or more T cell epitopes present in an HCV NS3 polypeptide. In some cases, the heterologous polypeptide comprises an amino acid sequence having at least 20% amino acid sequence identity to the following amino acid sequence: AIPLEVIK-GGRHLIFCHSKKKCDELAAKL (SEQ ID NO:1). In some cases, the heterologous polypeptide comprises an amino acid sequence having at least 20% amino acid sequence identity to the following amino acid sequence: AIPLEVIK-GGRHLIFCHSKKKCDELAAKLVALGINAVAYYRGLD-VSVIPTSG (SEQ ID NO:2). In some cases, the heterologous polypeptide comprises an amino acid sequence having at least 20% amino acid sequence identity to the following amino acid sequence: KGGRHLIFCHSKKKCDELAAK-LVALGINAVAYYRGLDVSVIPTSGDVVVVATD ALMT-GFTGDFDSVIDCN (SEQ ID NO:3). In some cases, the heterologous polypeptide comprises an amino acid sequence having at least 20% amino acid sequence identity to the following amino acid sequence: VALSTTGEIPFYG-KAIPLEVIKGGRHLIFCHSKKKCDELAAKLVALGI-NAVAYYR GLDVSVIPTSGDVVVVATDALMTGFTGD-FDSVIDCNTCVTQTVDF (SEQ ID NO:4). In some cases, the variant HCV E2 polypeptide comprises, in order from N-terminus to C-terminus: i) the heterologous polypeptide; and ii) the HCV E2 polypeptide. In some cases, the varian HCV E2 polypeptide comprises, in order from N-terminus to C-terminus: i) the HCV E2 polypeptide; and ii) the heterologous polypeptide. In some cases, the variant HCV E2 polypeptide comprises an immunoglobulin Fc polypeptide. In some cases, the variant HCV E2 polypeptide comprises, in order from N-terminus to C-terminus: i) the Fc polypeptide; ii) the heterologous polypeptide; and iii) the HCV E2 polypeptide. In some cases, the variant HCV E2 polypeptide comprises a proteolytic cleavage site interposed between the Fc polypeptide and the heterologous polypeptide. In some cases, the proteolytic cleavage site comprises the sequence LEVLFQGP (SEQ ID NO:5), wherein cleavage occurs between the glutamine and the glycine.

Figure 3B:
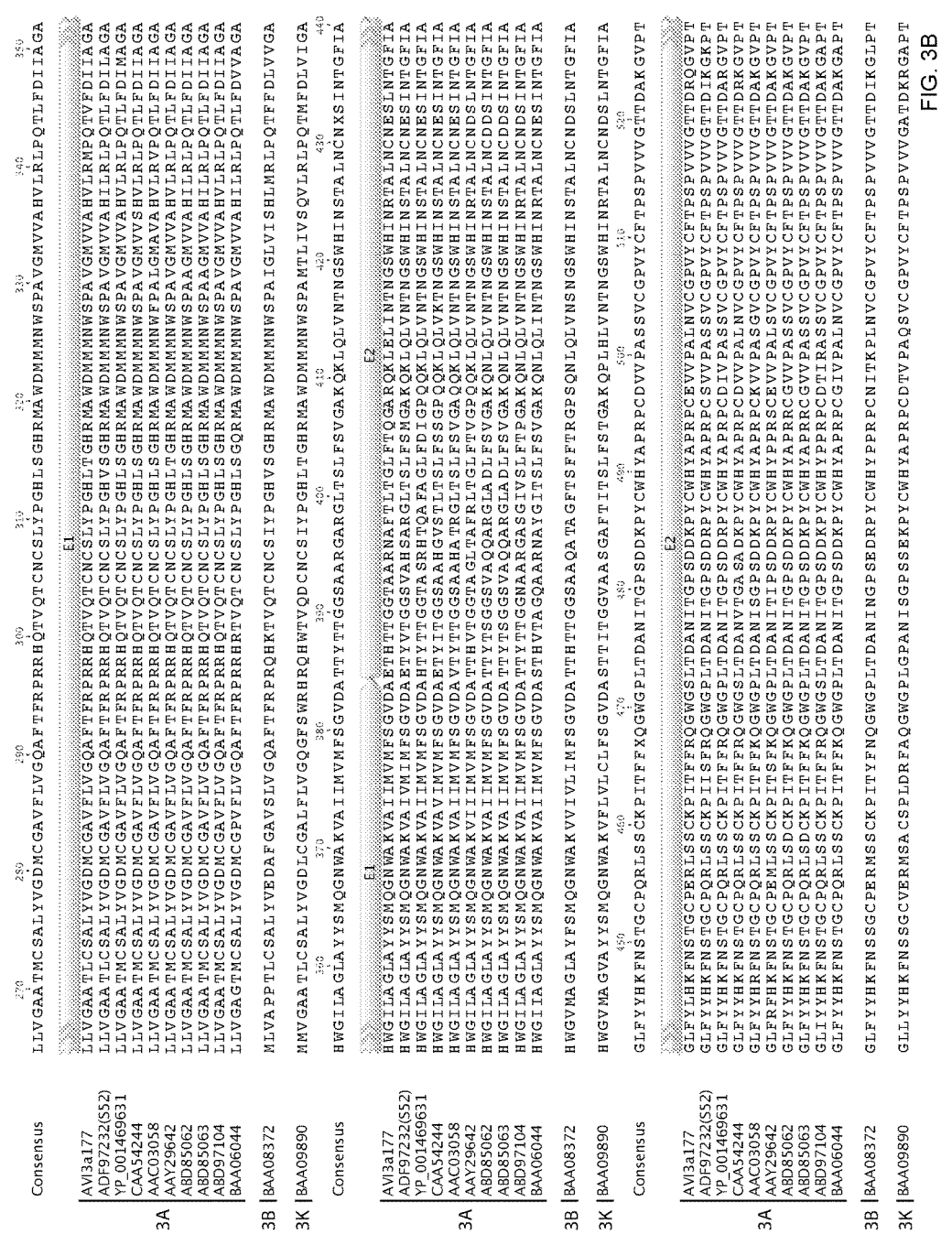
Figure 3C:
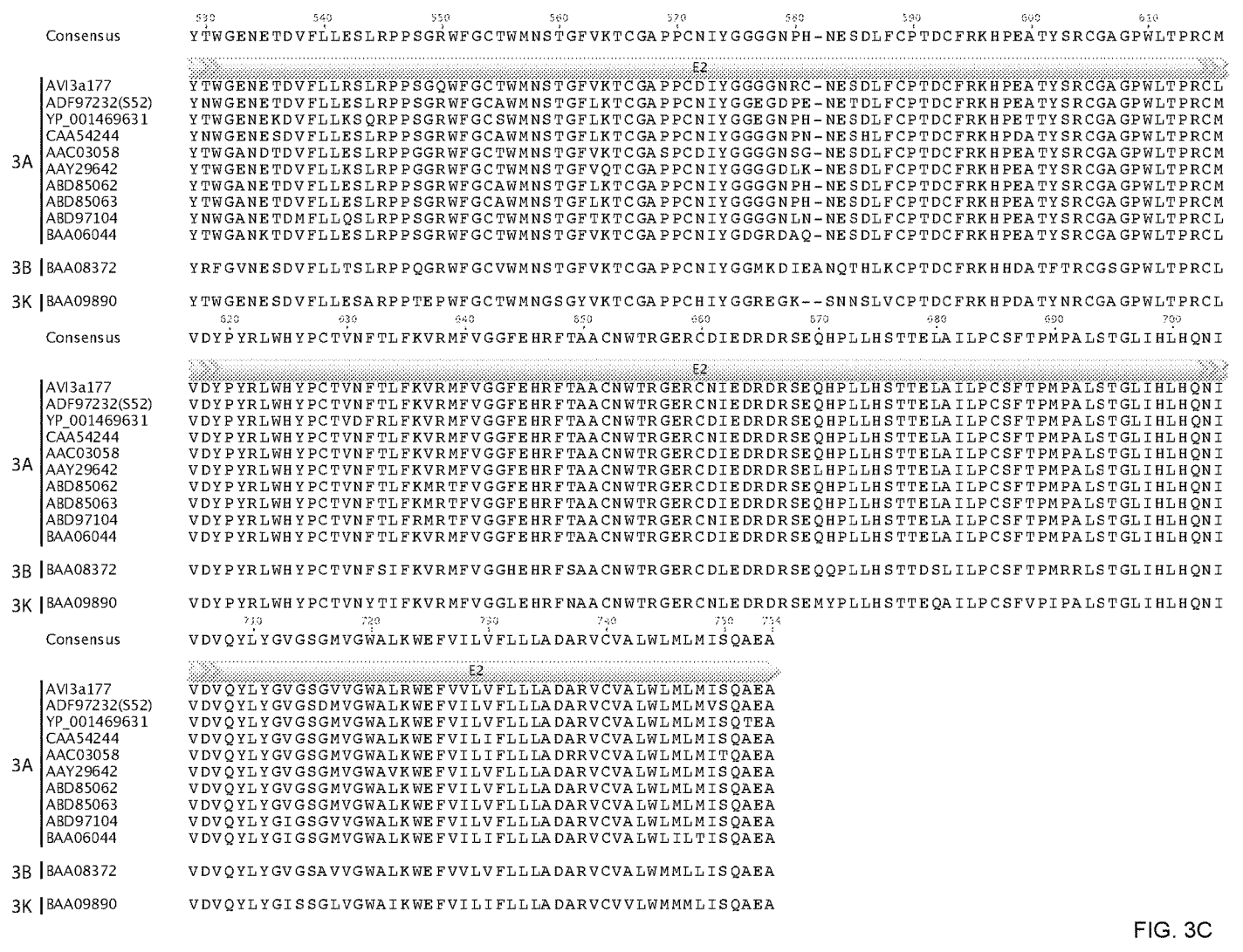

The present disclosure provides a variant HCV E1 polypeptide comprising: a) an HCV E1 polypeptide; and b) a heterologous polypeptide that comprises one or more T cell epitopes. In some cases, the HCV E1 polypeptide is derived from an HCV of genotype 1, 2, 3, or 7. In some cases, the HCV E1 polypeptide comprises an amino acid sequence having at least 20% amino acid sequence identity to an E1 polypeptide depicted in one of FIGS. 1A-1C, FIGS. 2A-2C, FIGS. 3A-3C, and FIGS. 4A-4B. In some cases, the heterologous polypeptide has a length of from about 10 amino acids to about 3000 amino acids. In some cases, the heterologous polypeptide has a length of from about 10 amino acids to about 100 amino acids. In some cases, the HCV E1 polypeptide lacks a transmembrane domain. In some cases, the heterologous polypeptide comprises one or more T cell epitopes present in one or more of: a) an HCV NS3 polypeptide; b) an HCV NS2 polypeptide; c) an HCV NS-4A polypeptide; d) an HCV NS4B polypeptide; e) an HCV NS5A polypeptide; f) an HCV NS5B polypeptide; g) an HCV core polypeptide; and h) an HCV p7 polypeptide. In some cases, the heterologous polypeptide comprises one or more T cell epitopes present in: a) cholera toxin or toxoid; and/or b) tetanus toxin or toxoid; and/or c) diphtheria toxin or toxoid; and/or d) CRM197. In some cases, the heterologous polypeptide comprises one or more T cell epitopes present in an HCV NS3 polypeptide. In some cases, the heterologous polypeptide comprises an amino acid sequence having at least 20% amino acid sequence identity to the following amino acid sequence: AIPLEVIKGGRHLIFCHS-KKKCDELAAKL (SEQ ID NO:1). In some cases, the heterologous polypeptide comprises an amino acid sequence having at least 20% amino acid sequence identity to the following amino acid sequence: AIPLEVIKGGRHLIFCHS-KKKCDELAAKLVALGINAVAYYRGLDVSVIPTSG (SEQ ID NO:2). In some cases, the heterologous polypeptide comprises an amino acid sequence having at least 20% amino acid sequence identity to the following amino acid sequence: KGGRHLIFCHSKKKCDELAAKLVALGI-NAVAYYRGLDVSVIPTSGDVVVVATD ALMTGFTGD-FDSVIDCN (SEQ ID NO:3). In some cases, the heterologous polypeptide comprises an amino acid sequence having at least 20% amino acid sequence identity to the following amino acid sequence: VALSTTGEIPFYGKAIPLEVIKG-GRHLIFCHSKKKCDELAAKLVALGINAVAYYR GLD-VSVIPTSGDVVVVATDALMTGFTGDFDSVID-CNTCVTQTVDF (SEQ ID NO:4). In some cases, the variant HCV E1 polypeptide comprises, in order from N-terminus to C-terminus: i) the heterologous polypeptide; and ii) the HCV E1 polypeptide. In some cases, the variant HCV E1 polypeptide comprises, in order from N-terminus to C-terminus: i) the HCV E1 polypeptide; and ii) the heterologous polypeptide. In some cases, the variant HCV E1 polypeptide comprises an immunoglobulin Fc polypeptide. In some cases, the variant HCV E1 polypeptide comprises, in order from N-terminus to C-terminus: i) the Fc polypeptide; ii) the heterologous polypeptide; and iii) the HCV E1 polypeptide. In some cases, the variant HCV E1 polypeptide comprises a proteolytic cleavage site interposed between the Fc polypeptide and the heterologous polypeptide. In some cases, the proteolytic cleavage site comprises the sequence LEVLFQGP (SEQ ID NO:5), wherein cleavage occurs between the glutamine and the glycine.

The present disclosure nucleic acid comprising a nucleotide sequence encoding a variant HCV E2 polypeptide as described above or elsewhere herein, or a variant HCV E1 polypeptide as described above or elsewhere herein. The present disclosure provides a recombinant expression vector comprising the nucleic acid. In some cases, the nucleotide sequence is operably linked to a promoter. In some cases, the promoter is functional in a eukaryotic cell. The present disclosure provides a genetically modified in vitro host cell comprising a nucleic acid as described above or elsewhere herein, or a recombinant vector as described above or elsewhere herein. In some cases, the host cell is a eukaryotic cell. In some cases, the host cell is a mammalian cell.

The present disclosure provides a method of inducing an immune response in an individual, the method comprising administering to the individual an effective amount of a heterodimeric polypeptide as described above or elsewhere herein, or a composition as described above or elsewhere herein. The present disclosure provides a method of inducing an immune response in an individual, the method comprising administering to the individual an effective amount of a nucleic acid as described above or elsewhere herein.

The present disclosure provides a method of inducing an immune response in an individual, the method comprising administering to the individual an effective amount of a recombinant expression vector as described above or elsewhere herein. In some cases, the recombinant expression vector is a recombinant modified vaccinia Ankara vector. In some cases, the recombinant expression vector is a recombinant replication-defective adenovirus. In some cases, administration of the recombinant expression vector is by intramuscular administration. In some cases, administration of the recombinant expression vector is by subcutaneous administration.

BRIEF DESCRIPTION OF THE DRAWINGS

Figure 1A:
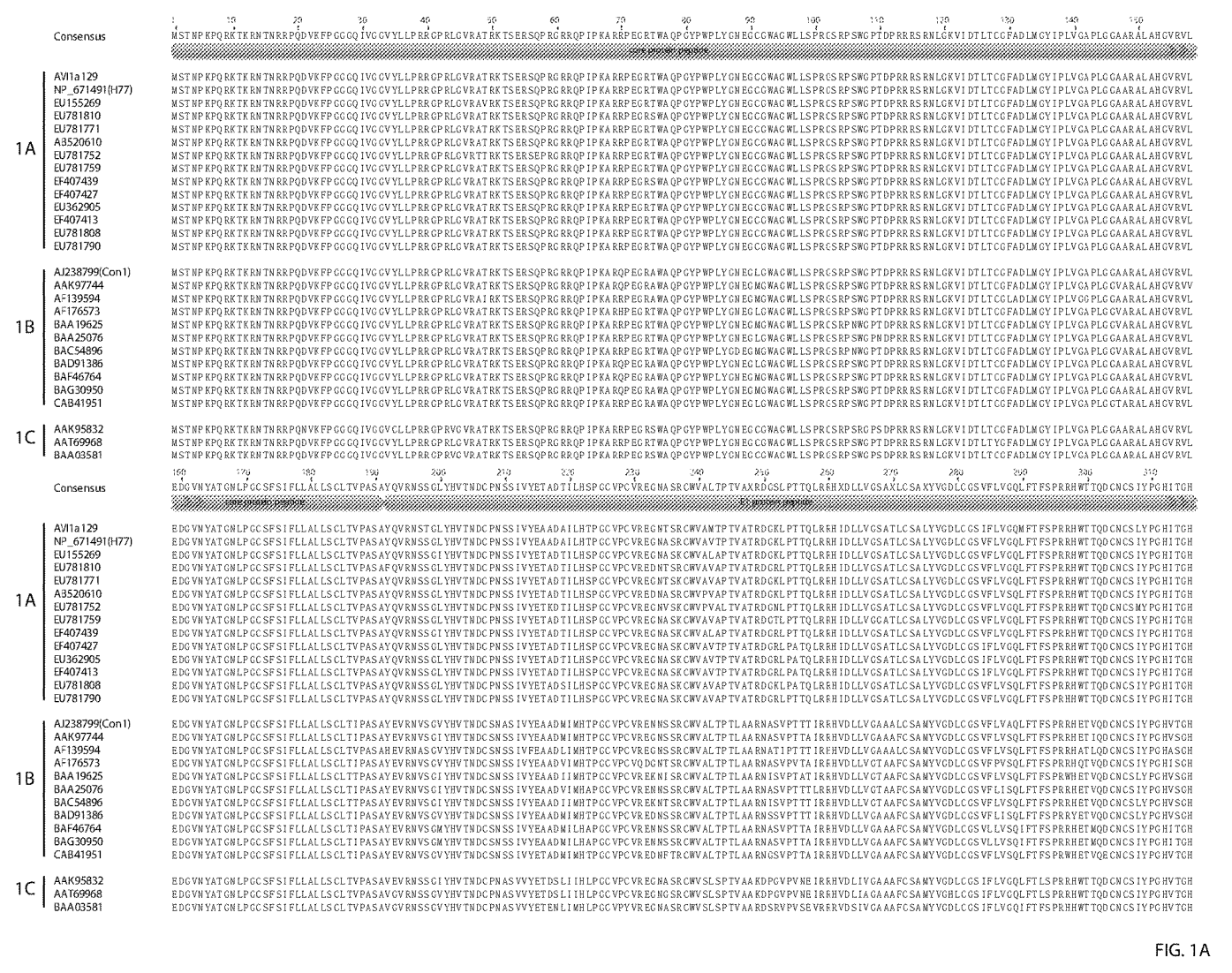

FIGS. 1A-1C provide an amino acid sequence alignment of examples of the core-E1-E2 coding regions of a HCV genotype 1 virus, specifically representative HCV 1A, 1B and 1C genotypes. Genbank database sequences for the coding region core-E1-E2 were aligned using Geneious software v5.6.4. Numbering of amino acids is according to strain NP_671941 (H77). Consensus: SEQ ID NO:74; AVI1a129: SEQ ID NO:75; NP_671491 (H77): SEQ ID NO:76; EU155269: SEQ ID NO:77; EU781810: SEQ ID NO:78; EU781771: SEQ ID NO:79; AB250610: SEQ ID NO:80; EU781752: SEQ ID NO:81; EU781759: SEQ ID NO:82; EF407439: SEQ ID NO:83; EF407427: SEQ ID NO:84; EU362905: SEQ ID NO:85; EF407413: SEQ ID NO:86; EU781808: SEQ ID NO:87; EU78170: SEQ ID NO:88; AJ238799 (Con1): SEQ ID NO:89; AAK97744: SEQ ID NO:90; AF139594: SEQ ID NO:91; AF176573: SEQ ID NO:92; BAA19625: SEQ ID NO:93; BAA25076: SEQ ID NO:94; BAC54896: SEQ ID NO:95; BAD91386: SEQ ID NO:96; BAF46764: SEQ ID NO:97; BAG30950: SEQ ID NO:98; CAB41951: SEQ ID NO:99; AAK95832: SEQ ID NO:100; AAT69968: SEQ ID NO:101; and BAA03581: SEQ ID NO:102.

FIGS. 2A-2C provide an alignment of amino acid sequences of the core-E1-E2 coding region of representative HCV 2A and HCV2B subtypes. Genbank database sequences for the coding region core-E1-E2 were aligned using Geneious software v5.6.4. The amino acid numbering depicted is in accordance to the common HCV strains: AB047639 (JFH1) and HPCJ8G-J8 (J8) for HCV2A and HCV2B, respectively. AB047639 (JFH1): SEQ ID NO:103; AB047645: SEQ ID NO:104; AF169003: SEQ ID NO:105; AF169005: SEQ ID NO:106; AF238482: SEQ ID NO:107; AY746460: SEQ ID NO:108; HPCPOLP: SEQ ID NO:109; NC_009823: SEQ ID NO:110; HPCJ8G HC-J8: SEQ ID NO:111; AB030907: SEQ ID NO:112; AY232730: SEQ ID NO:113; AY232747: SEQ ID NO:114; and DQ430817: SEQ ID NO:115.

FIGS. 3A-3C provide an amino acid sequence alignment of the core-E1-E2 coding region for representative HCV 3A, 3B and 3K genotypes. Genbank database sequences for the coding region core-E1-E2 were aligned using Geneious software v5.6.4. Consensus: SEQ ID NO:116; AVI3a177: SEQ ID NO:117; ADF97232(S52): SEQ ID NO:118; YP_0014696: SEQ ID NO:119; CAA54244: SEQ ID NO:120; AAC03058: SEQ ID NO:121; AAY29642: SEQ ID NO:122; ABD85062: SEQ ID NO:123; ABD85063: SEQ ID NO:124; ABD97104: SEQ ID NO:125; BAA06044: SEQ ID NO:126; BAA08372: SEQ ID NO:127; and BAA09890: SEQ ID NO:128.

FIGS. 4A-4B provide an amino acid sequence of the core-E1-E2 coding region for HCV genotype 7a. Amino acid sequence for the coding region core-E1-E2 of genotype 7a (isolate QC69; Genbank: ABN05226.1; SEQ ID NO: 129) is shown according to the numbering scheme of the reference strain, NP_671941 (H77).

Figures 5A, 5B:
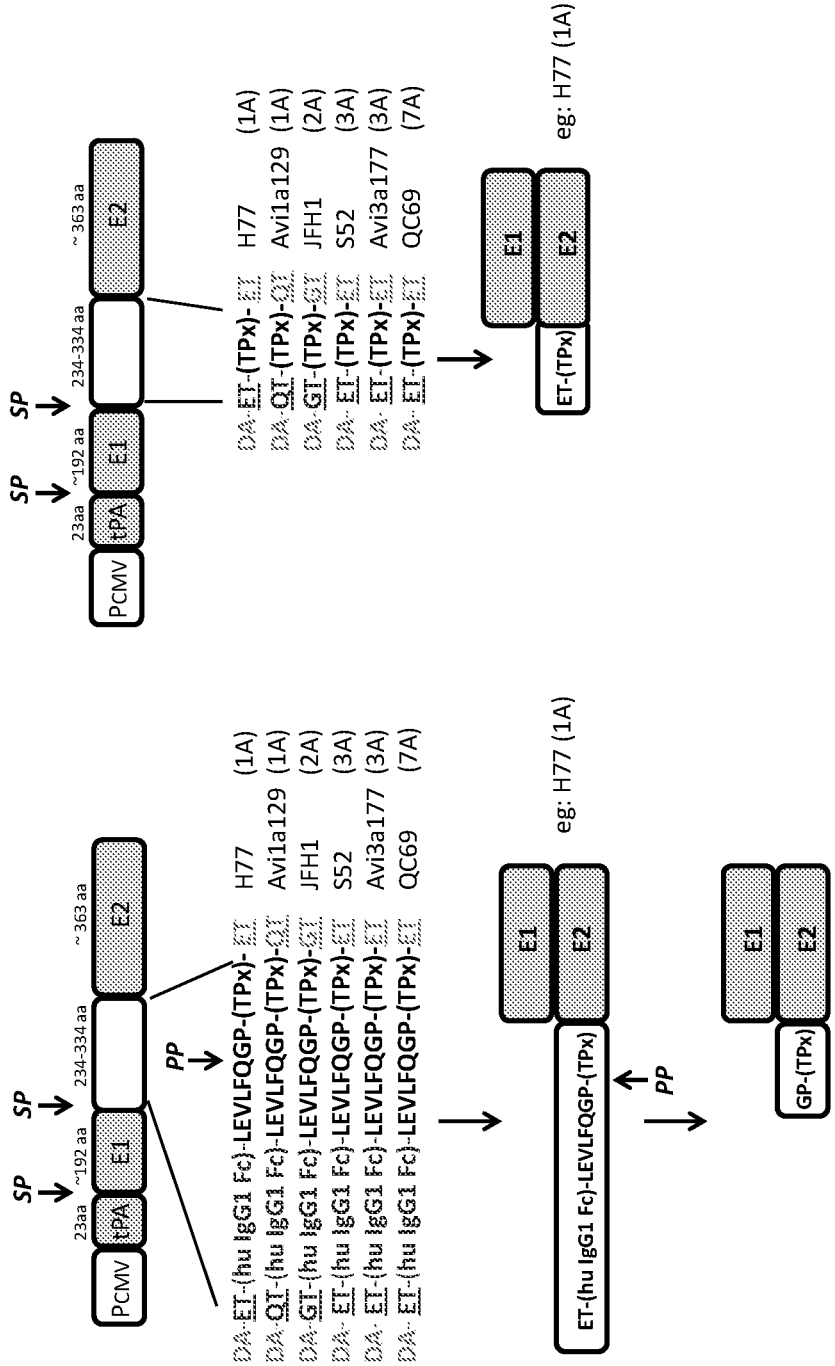

FIGS. 5A-5B present schematic representations of Fc-tagged and untagged E1E2 expression constructs and polypeptide processing. FIG. 5A depicts a schematic representation of an Fc-tagged E1E2 expression construct and polypeptide processing. SP denotes signal peptidase cleavage site. PP denotes cleavage site for precision protease. TPx denotes the addition of a polytope (a polypeptide comprising T-cell epitope(s)) to the E1E2 polypeptide at the N-terminus of E2. SEQ ID NO:5. FIG. 5B depicts a schematic representation of an un-tagged E1E2 expression construct and polypeptide processing.

FIGS. 6A-6B depict an alignment of Fc-tagged E1-E2 polypeptide, with and without a polytope (TPx) for H77 (GenBank NP_671941) and Alberta isolate Avi1a129 (genotype 1A). AVI1a129: SEQ ID NO:130; AVI1a129TP29: SEQ ID NO:131; AVI1a29TP52: SEQ ID NO:132; AVI1a129TP100: SEQ ID NO:133; H77: SEQ ID NO:134; H77 TP29: SEQ ID NO:135; H77 TP52: SEQ ID NO:136; H77 TP100: SEQ ID NO:137.

Figure 7A:
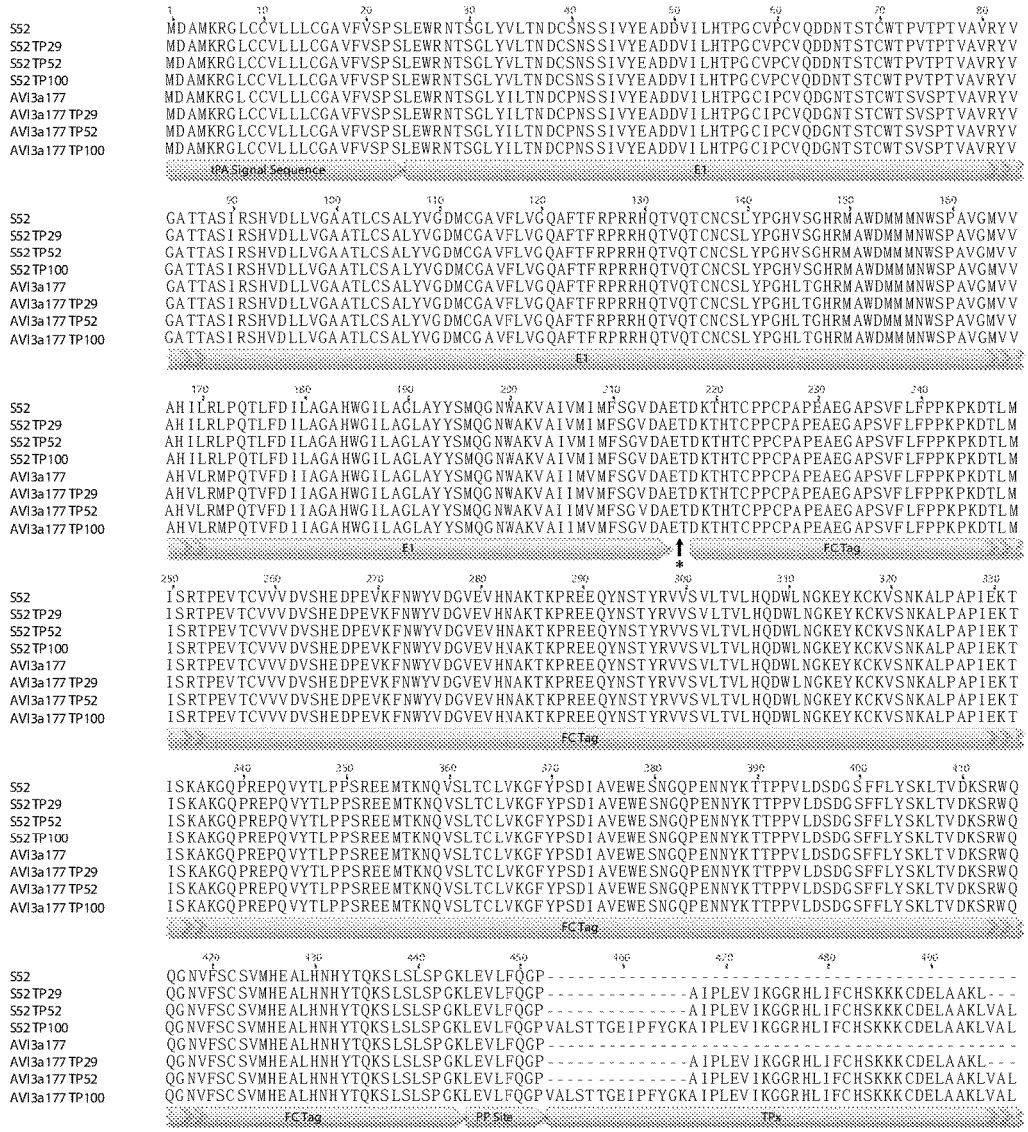

FIGS. 7A-7B depict an alignment of Fc-tagged E1-E2 polypeptide, with and without a polytope (TPx) for S52 (GenBank ADF97232.1) and Alberta isolate Avi3a177 (genotype 3A). S52: SEQ ID NO:138; S52 TP29: SEQ ID NO:139; S52 TP52: SEQ ID NO:140; S52 TP100: SEQ ID NO:141; AVI3a177: SEQ ID NO:142; AVI3a177 TP29: SEQ ID NO:143; AVI3a177 TP52: SEQ ID NO:144; AVI3a177 TP100: SEQ ID NO:145.

Figure 8A:
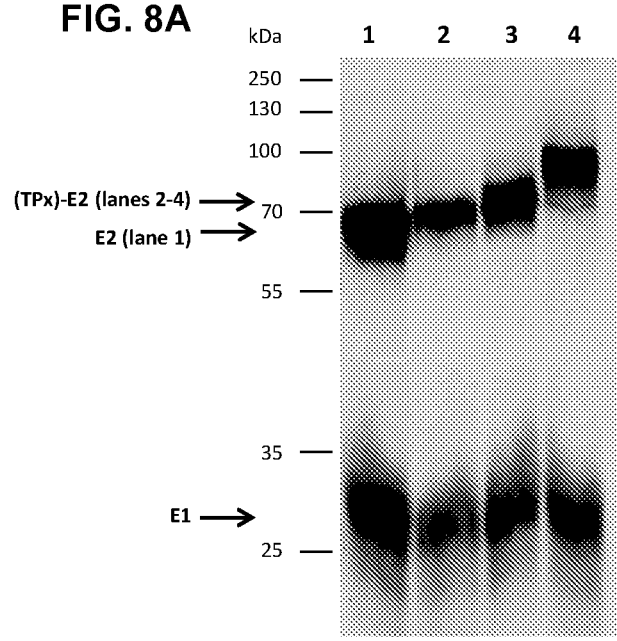
Figure 8B:
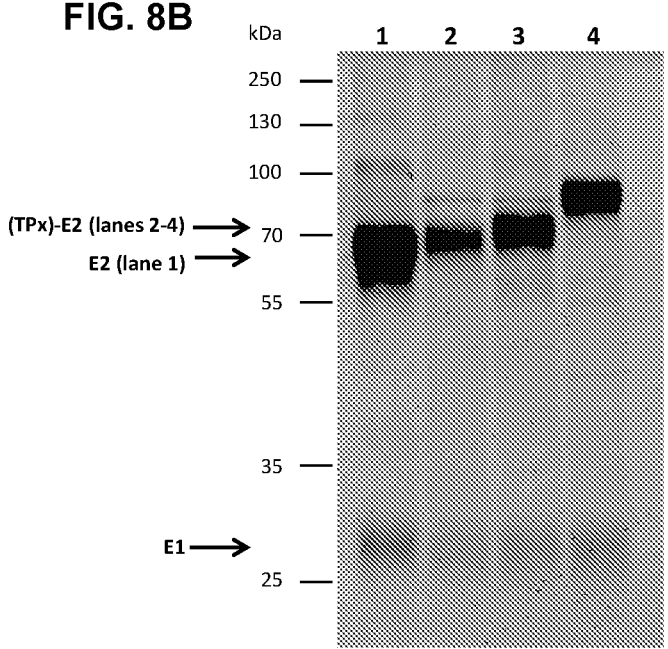

FIGS. 8A-8B depict purification of an E1E2 heterodimer from CHO cell extracts expressing Fc-tagged E1E2.

FIGS. 9A-9C provide amino acid sequences of immunoglobulin Fc regions (SEQ ID NOs: 146-153).

FIG. 10 presents Table 1, which provides conserved regions based on conserved CD4 epitopes (CD4$^+$ T cell epitopes) (SEQ ID NOs:154-164).

FIG. 11 presents Table 2, which provides the number of located HCV CD8$^+$ T cell epitopes and anchor positions for common human leukocyte antigen (HLA)-I Alleles in the United States.

FIG. 12 presents Table 3, which provides conserved regions based on conserved CD8 epitopes (CD8$^+$ T cell epitopes) (SEQ ID NOs:165-174).

FIGS. 13A-13B provide a list of CD4 and CD8 epitopes that are conserved amond HCV genotypes 1a, 1b, 2a, 2b, and 3.

FIGS. 14A-14D provide amino acid sequences of examples of T-cell polytopes ("TP"). The start and end amino acids are based on the sequence designated "Consensus" in FIGS. 16A-16L. The T-cell epitopes contained within each TP are provided; the T-cell epitope designations correspond to those presented in FIGS. 15A-15N (SEQ ID NOs:175-184).

Figure 15A:
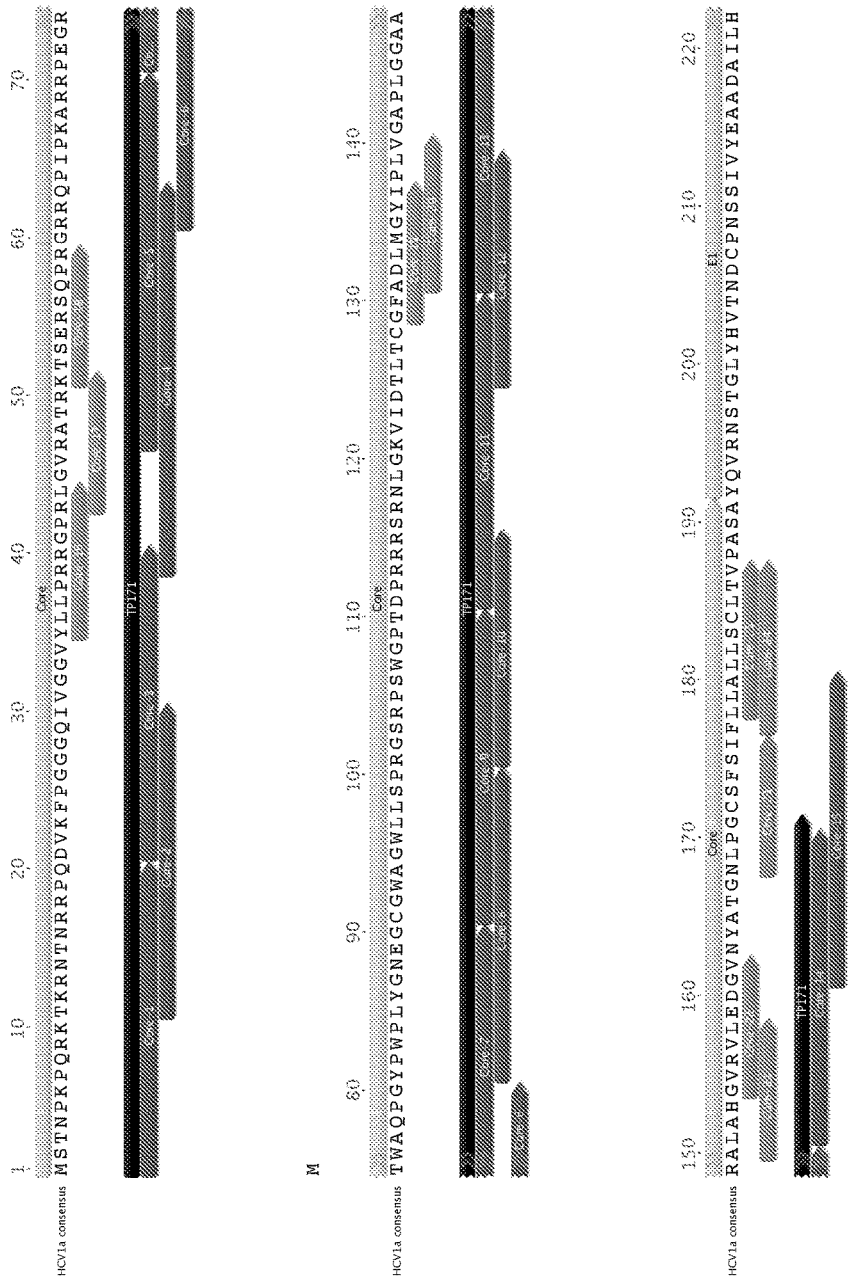
Figure 15B:
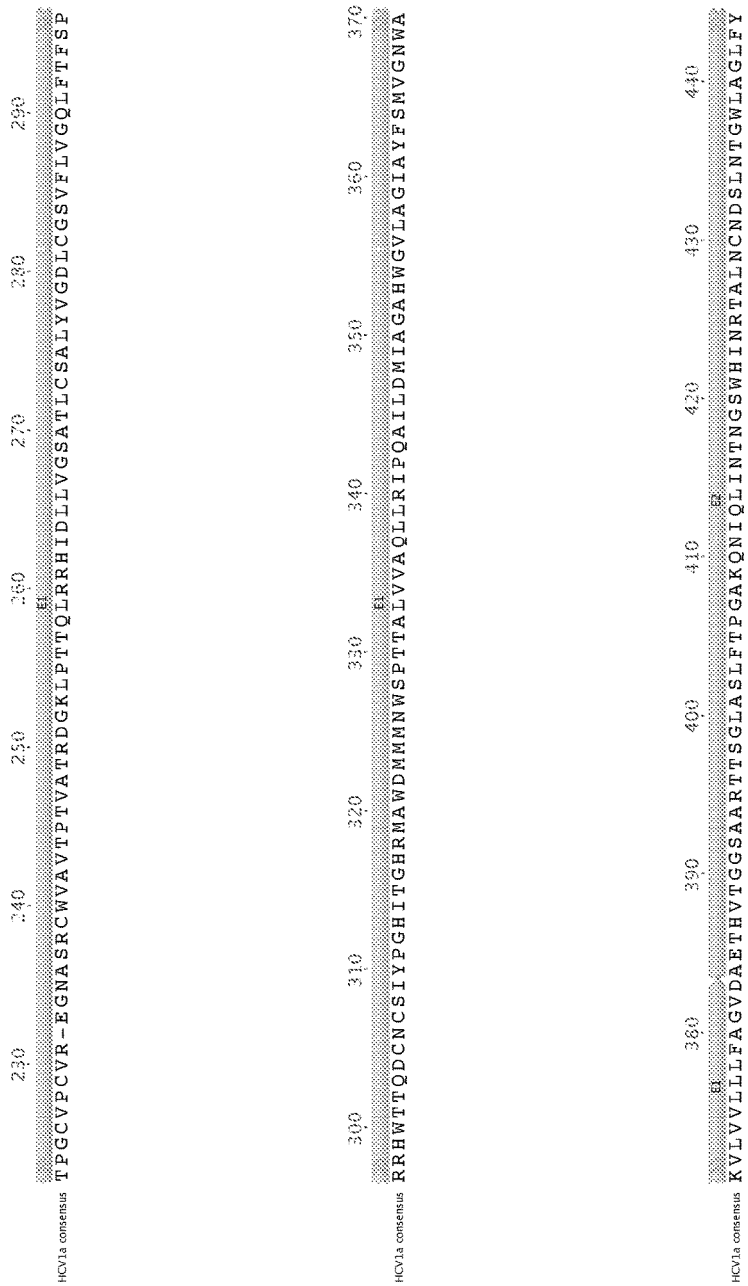
Figure 15C:
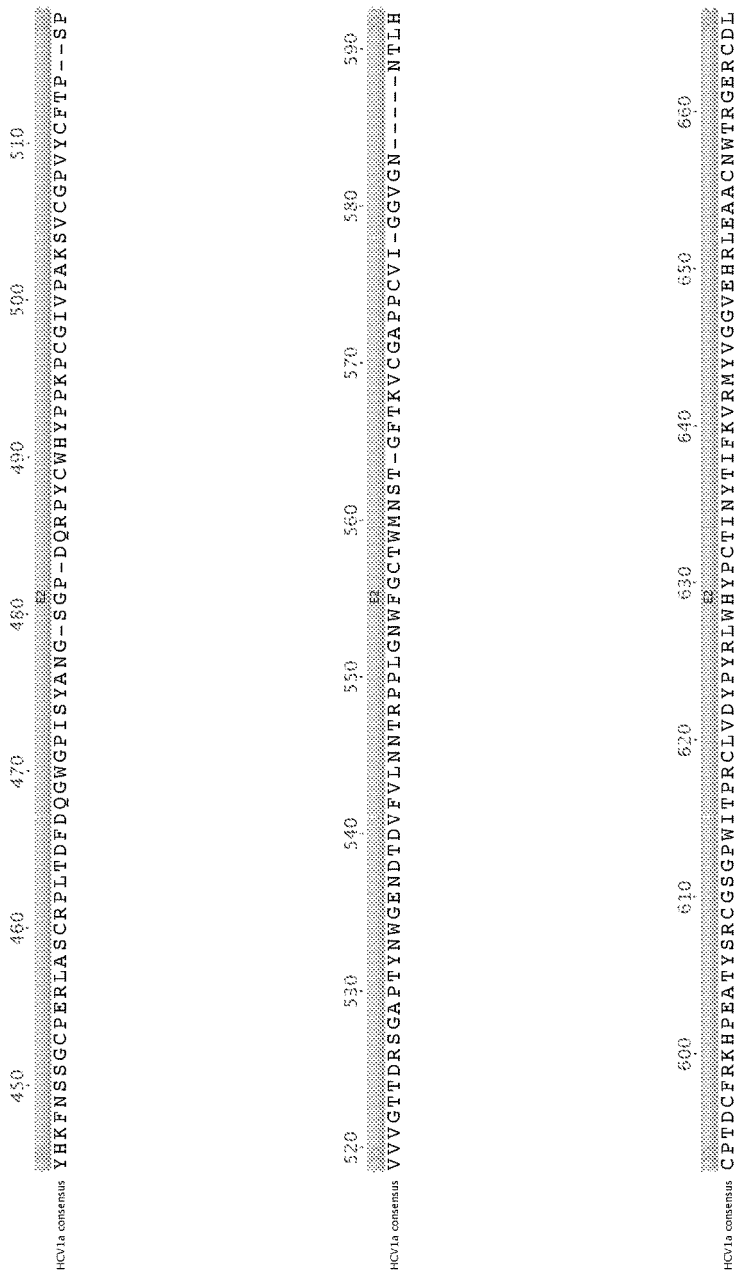

FIGS. 15A-15N provide consensus amino acid sequences of HCV polypeptides; and depict the locations of T-cell epitopes (SEQ ID NO:185).

Figure 16A:
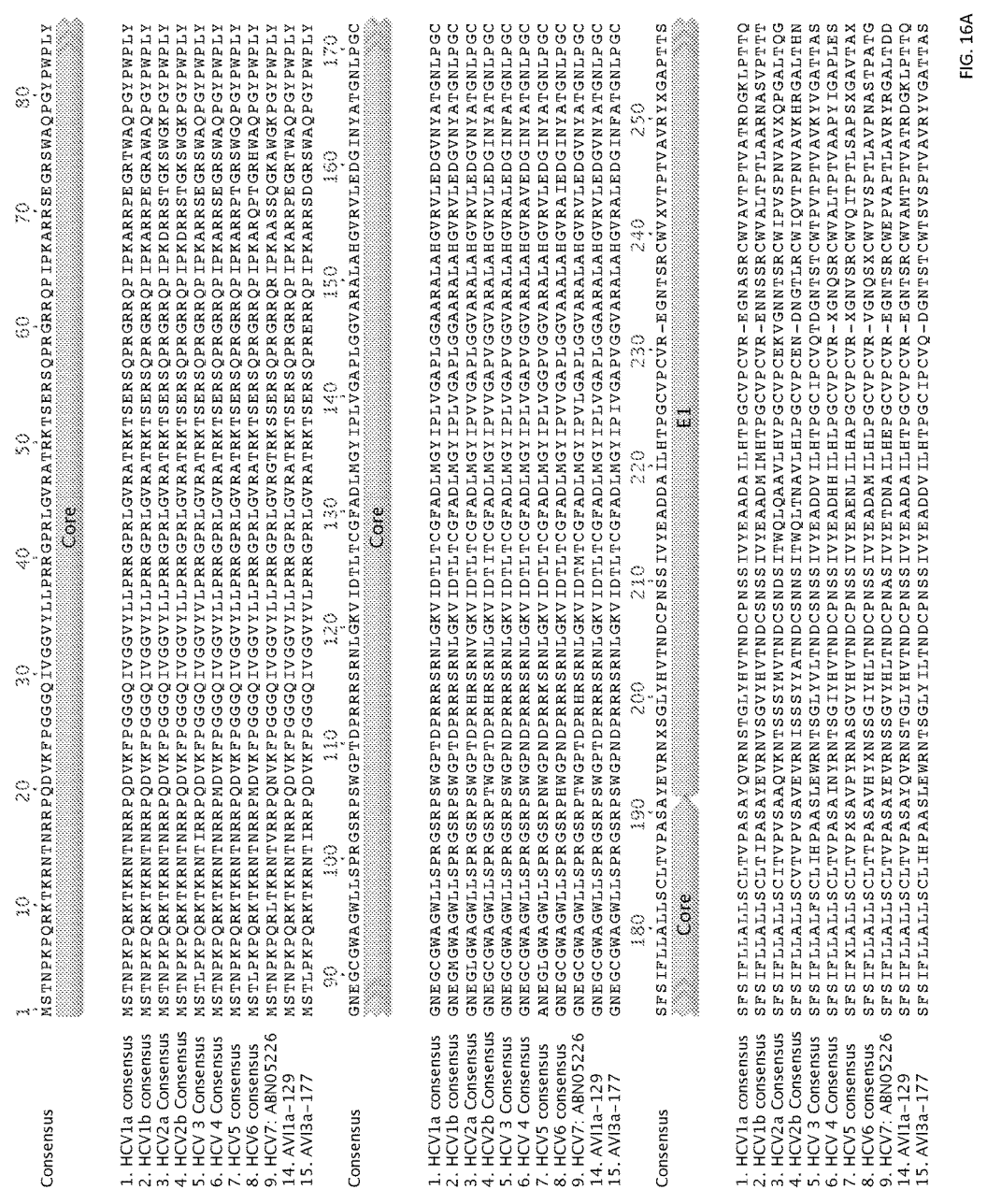
Figure 16B:
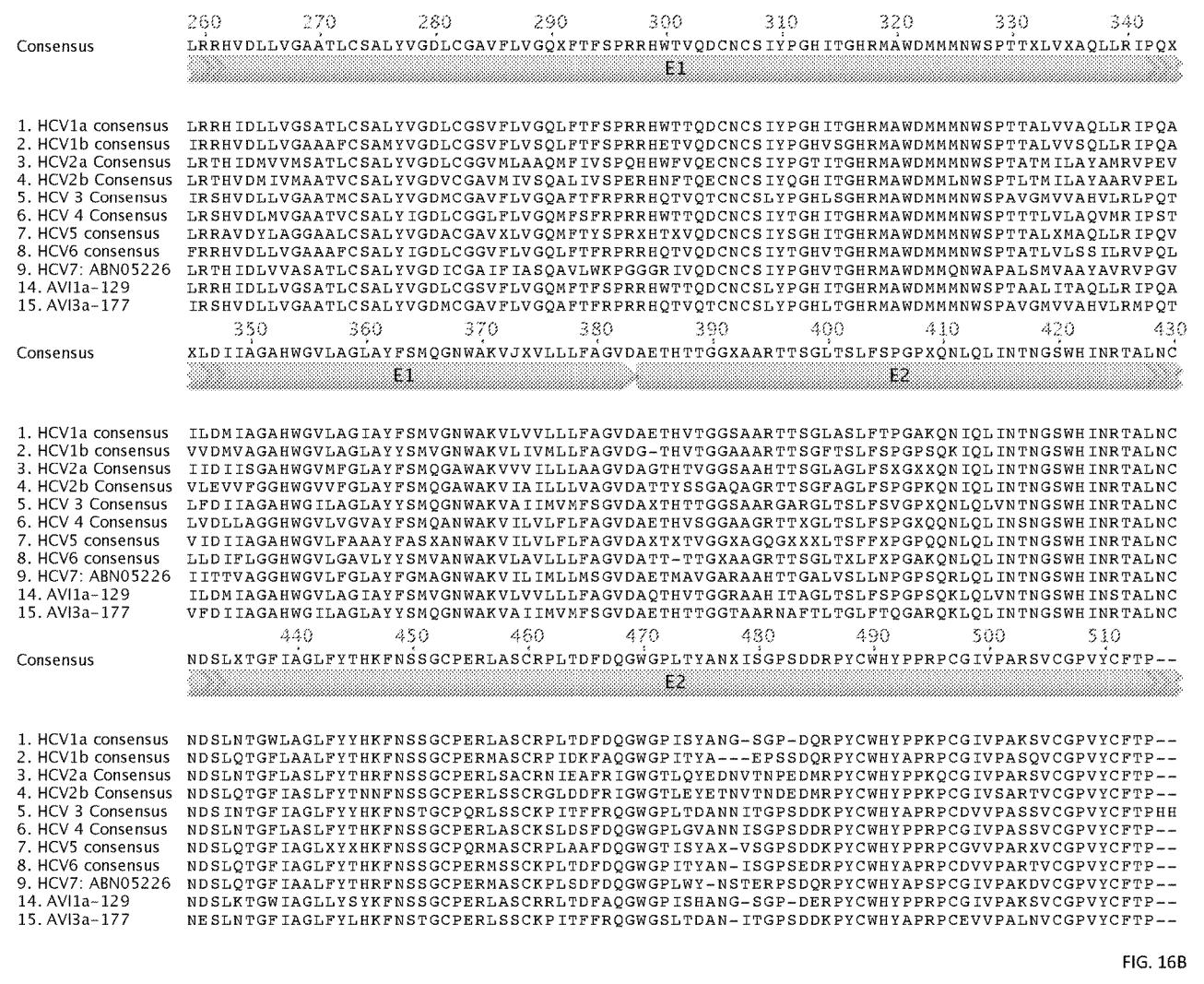
Figure 16C:
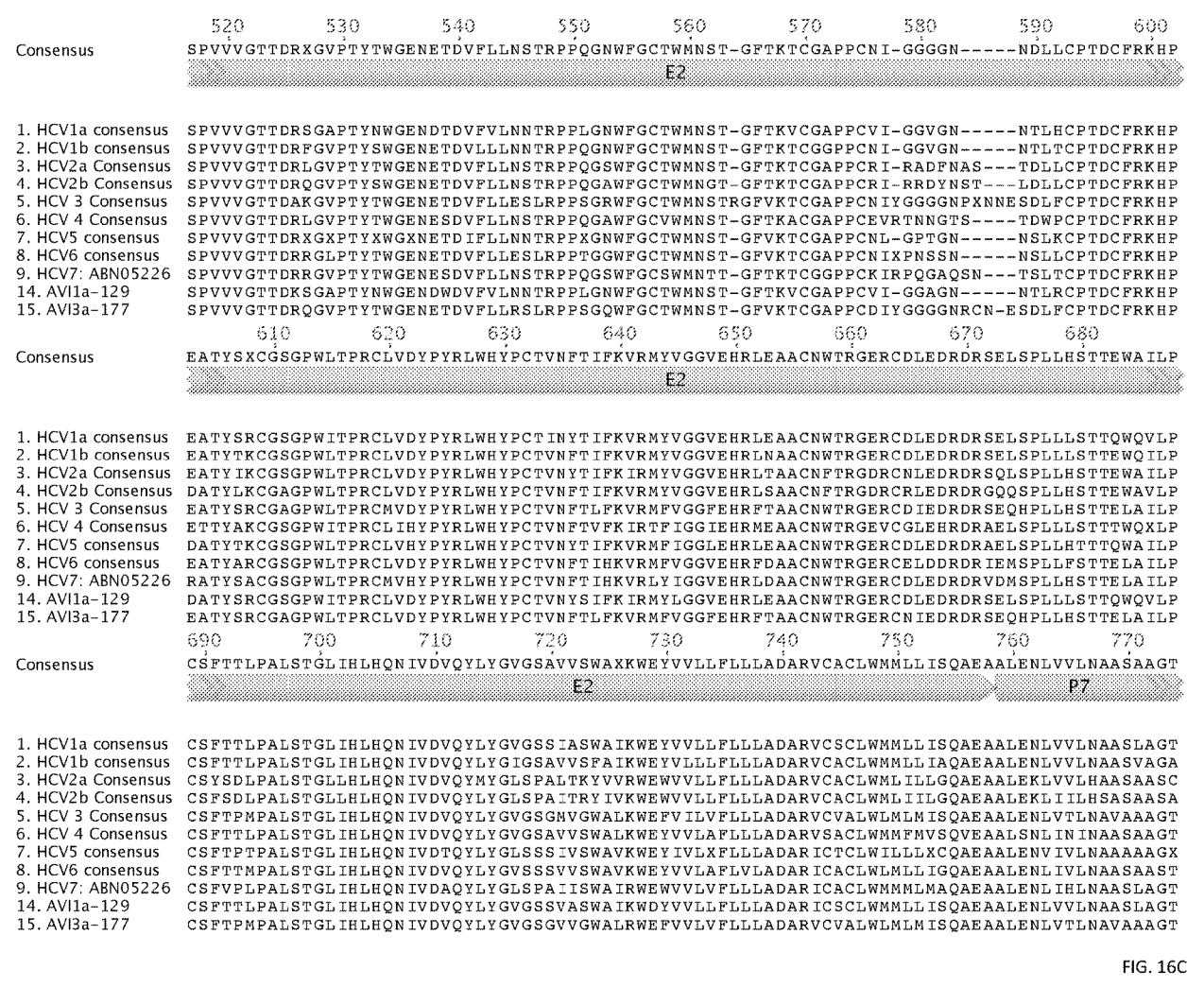
Figure 16D:
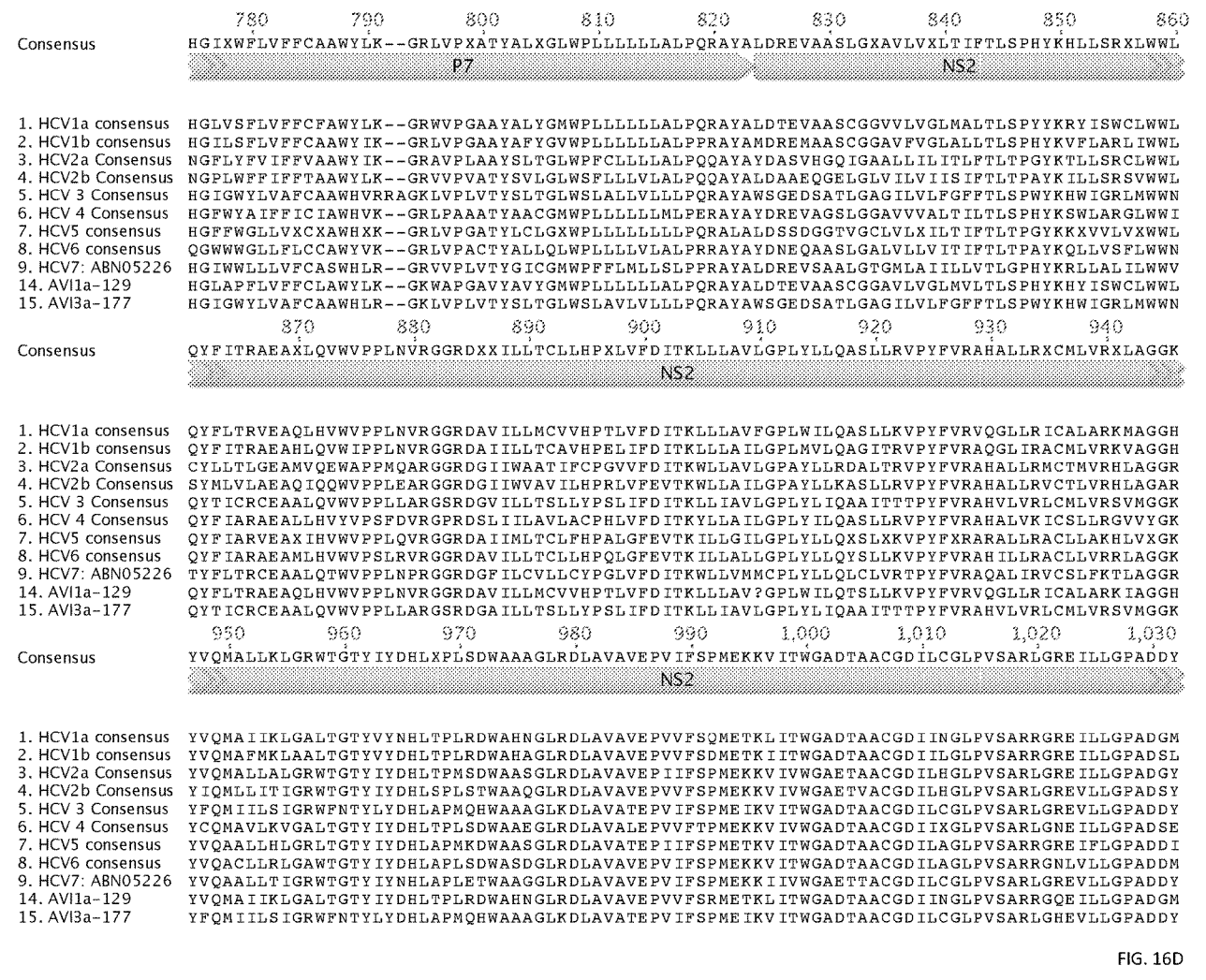
Figure 16E:
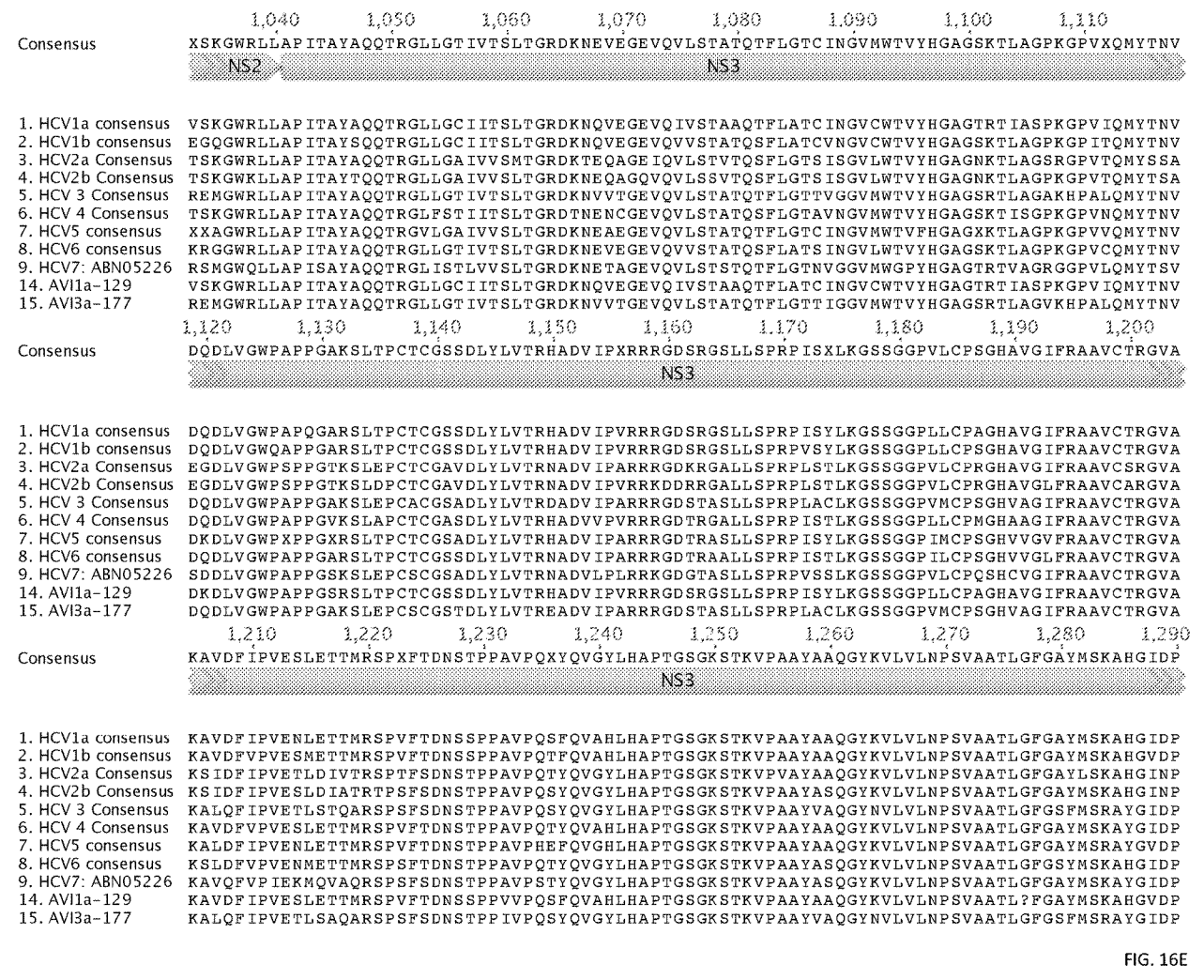
Figure 16F:
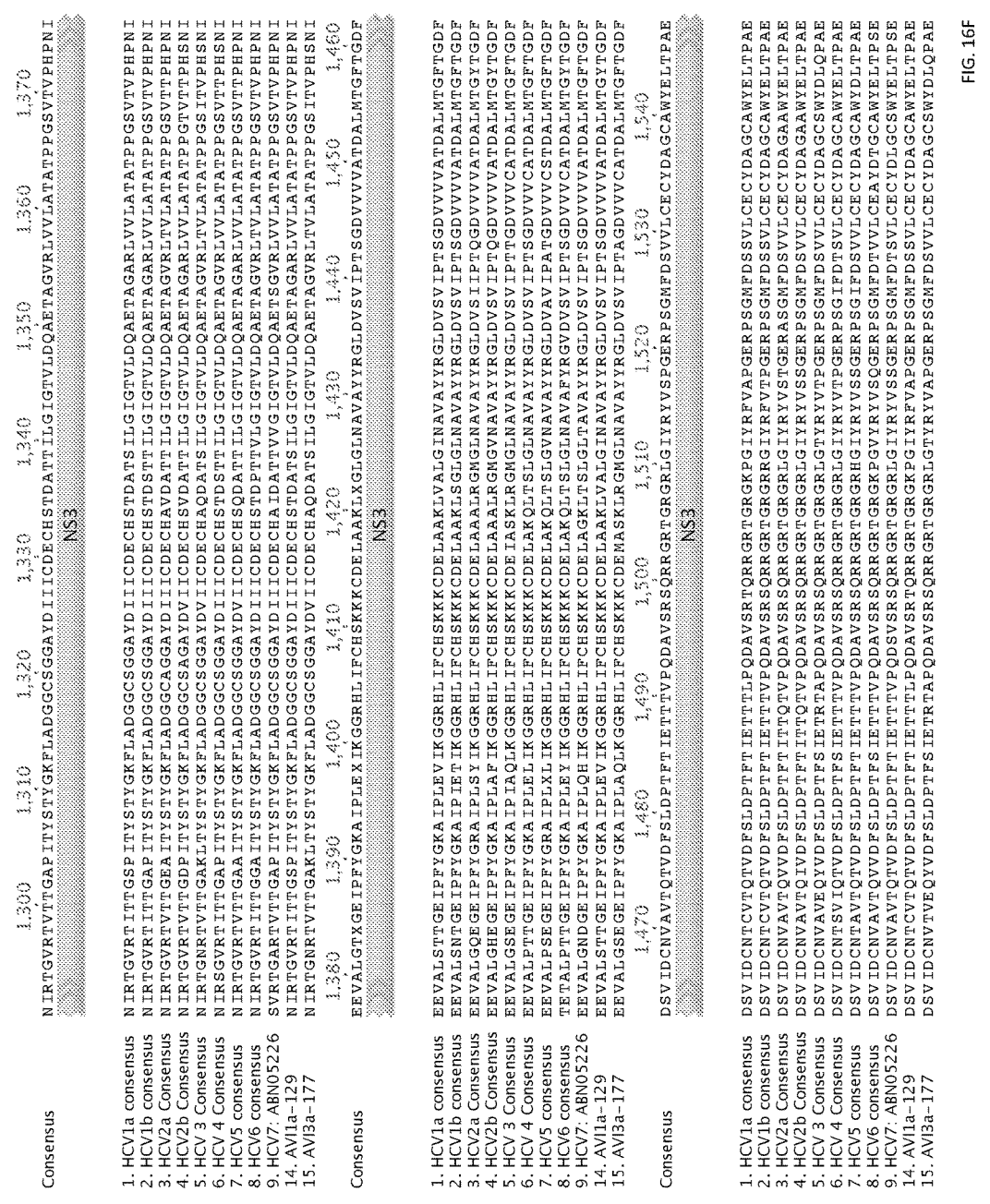
Figure 16G:
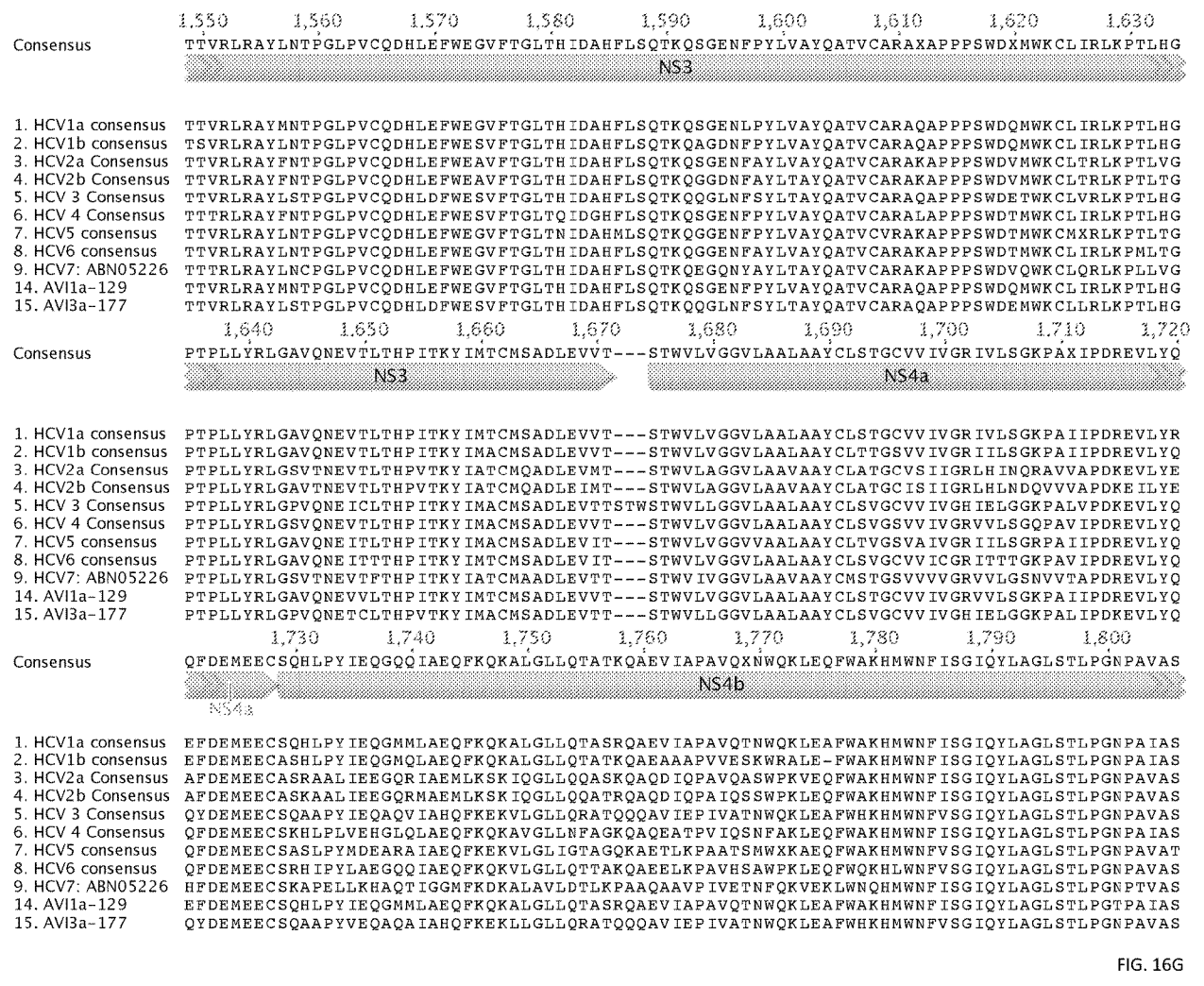
Figure 16H:
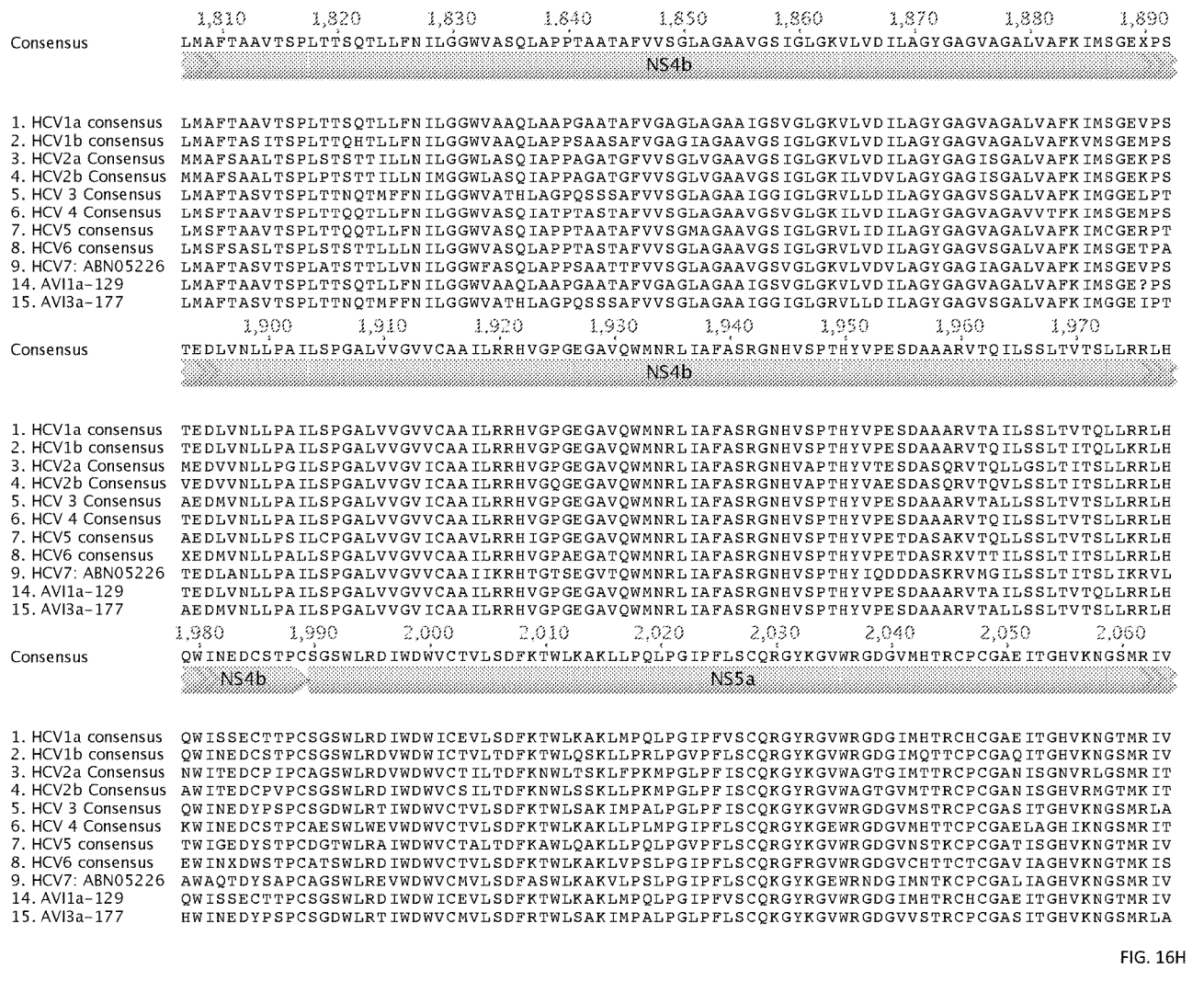
Figure 16I:
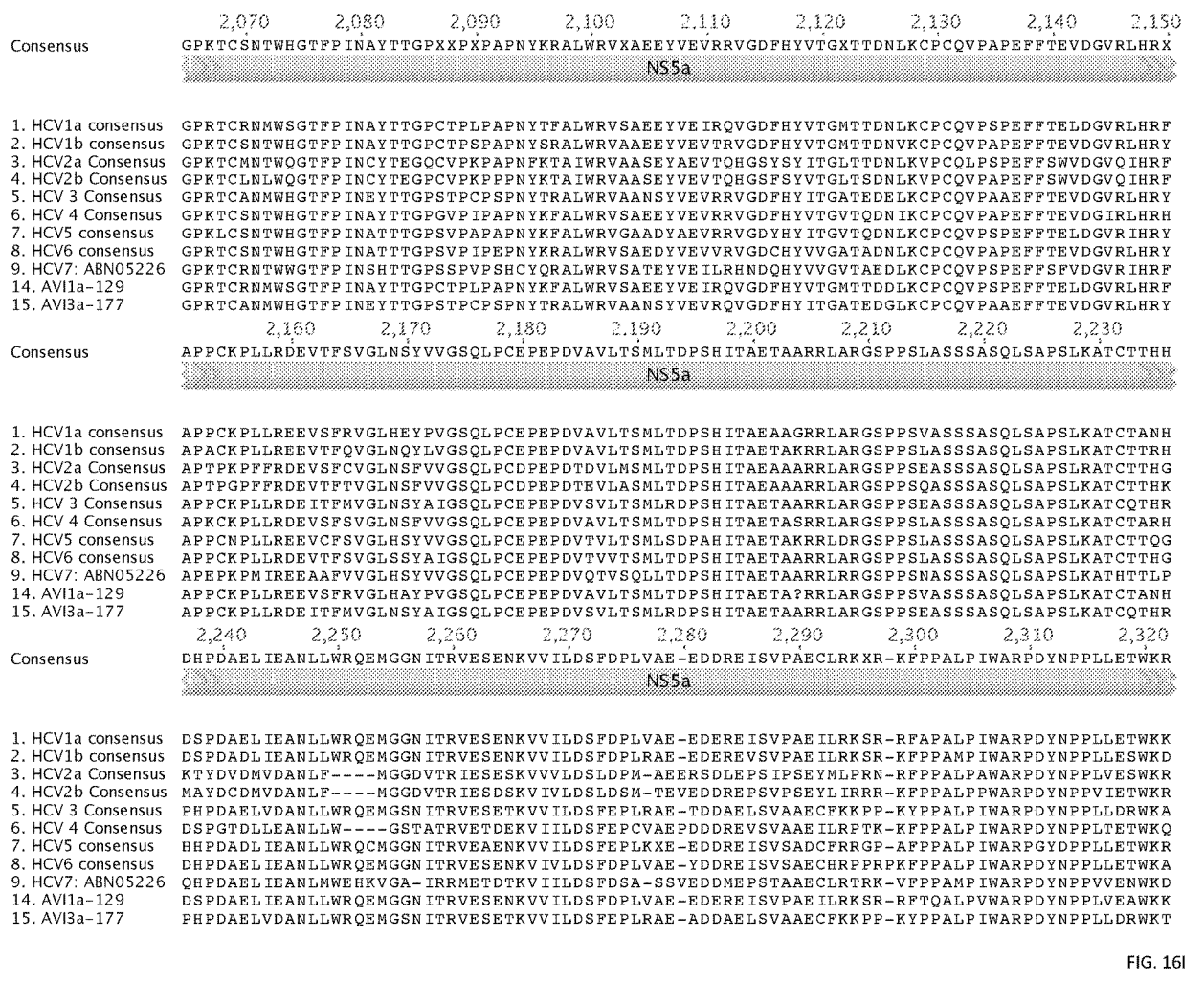
Figure 16J:
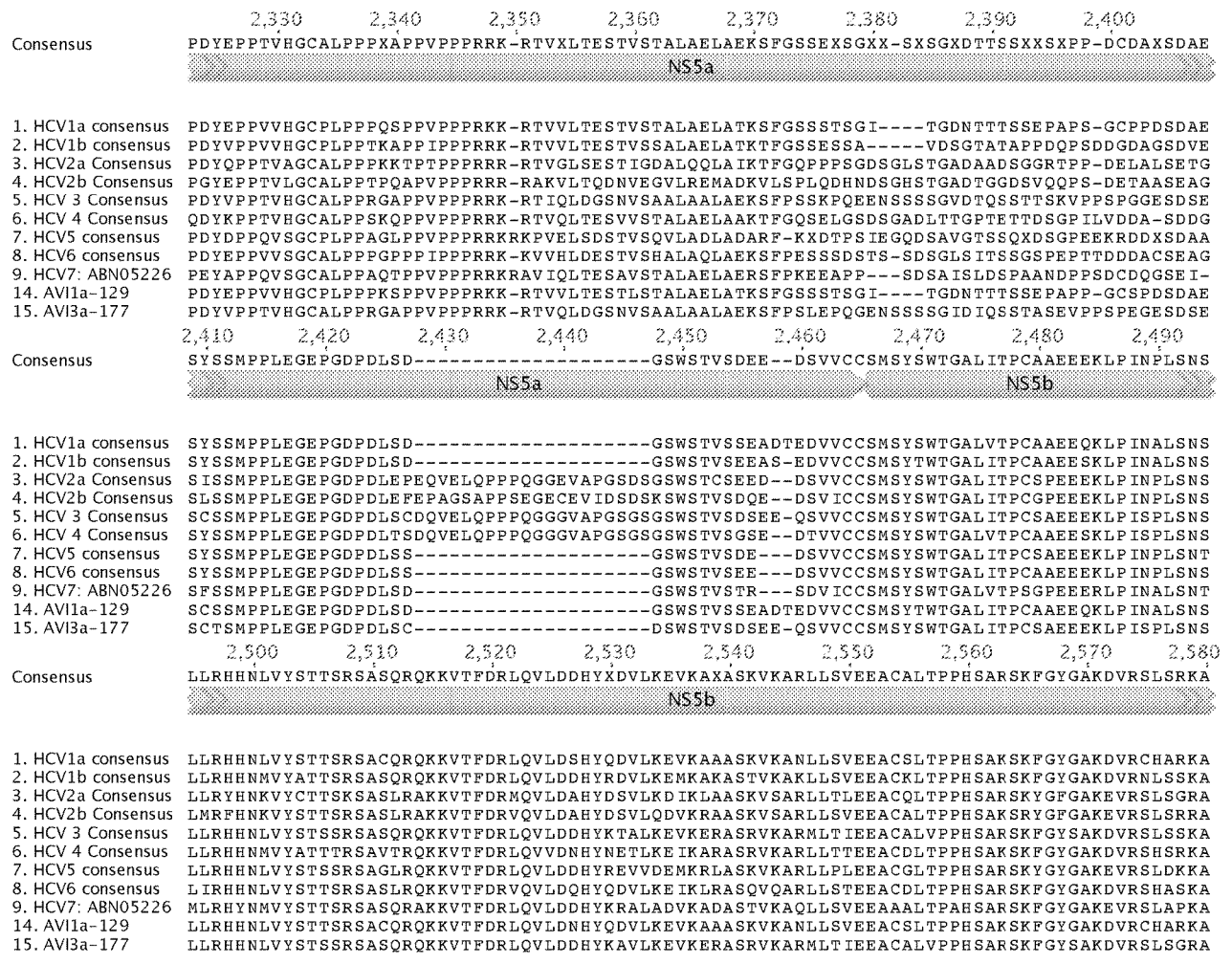
Figure 16K:
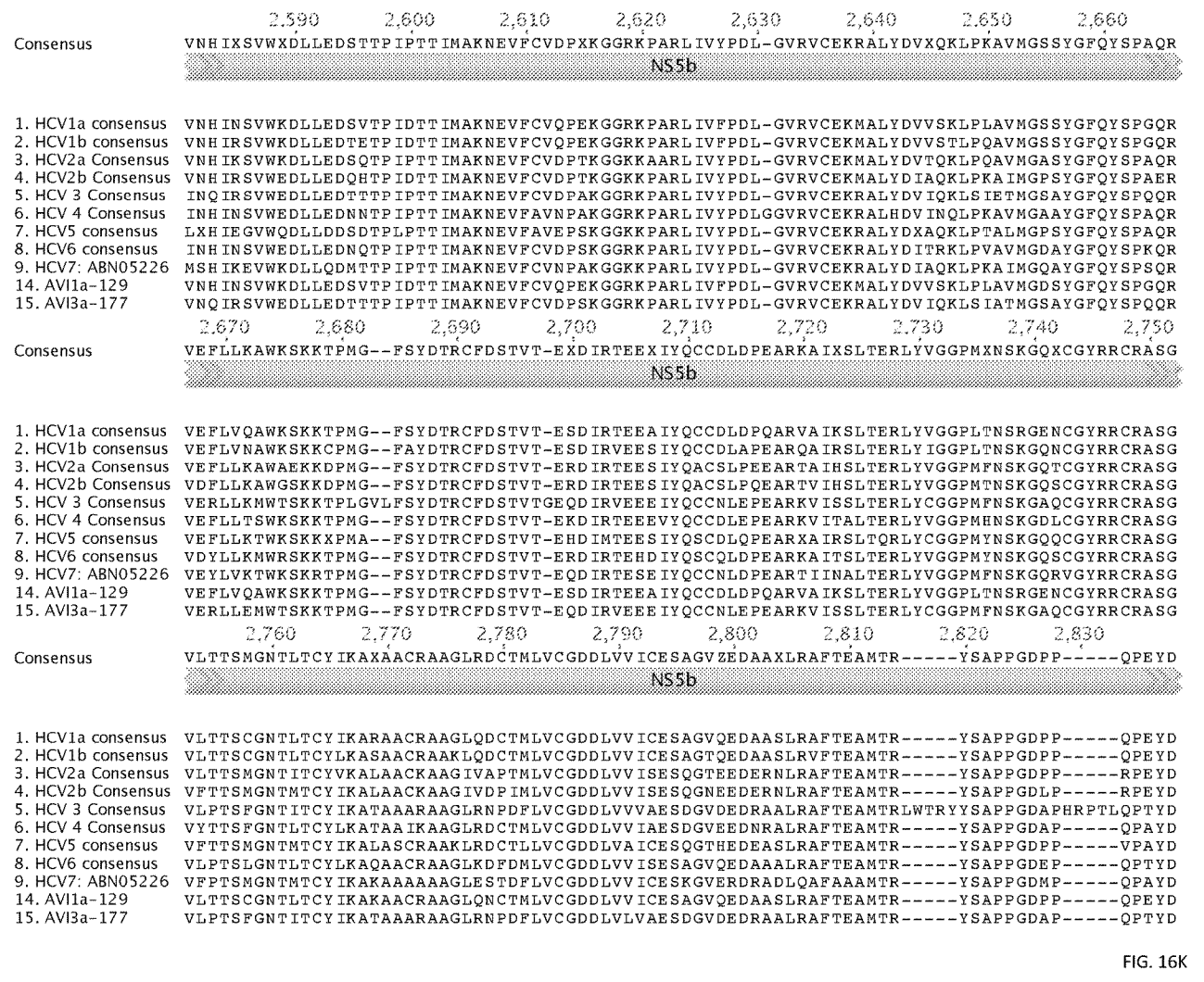
Figure 16L:
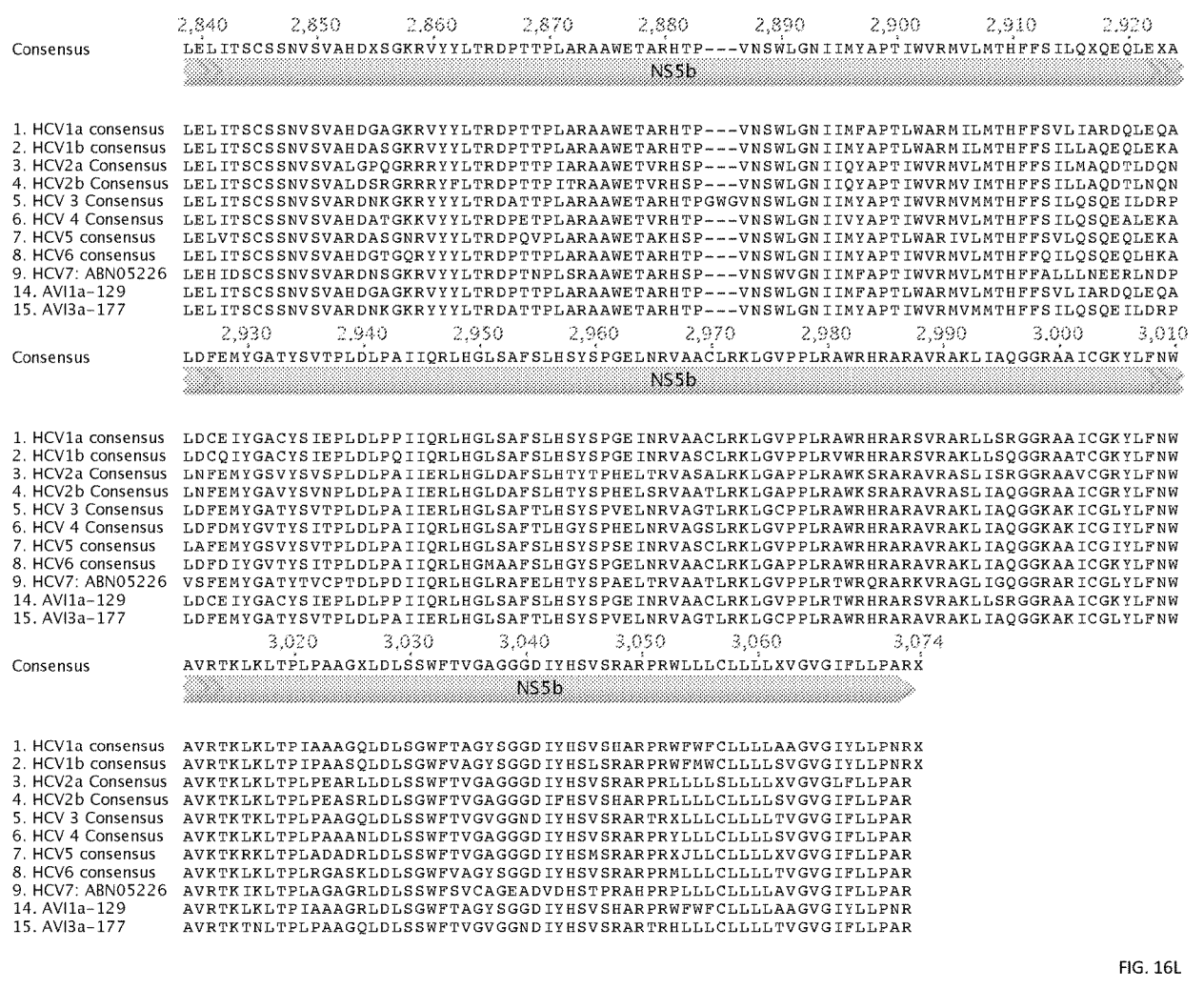

FIGS. 16A-16L provide consensus amino acid sequences of HCV polypeptides (SEQ ID NOs:186-197).

DEFINITIONS

The term "hepatitis C virus" ("HCV"), as used herein, refers to any one of a number of different genotypes and isolates of hepatitis C virus. Thus, "HCV" encompasses any of a number of genotypes, subtypes, or quasispecies, of HCV, including, e.g., genotype 1, 2, 3, 4, 6, 7, etc. and subtypes (e.g., 1a, 1b, 2a, 2b, 3a, 4a, 4c, etc.), and quasispecies. Representative HCV genotypes and isolates include: the "Chiron" isolate HCV-1, H77, J6, Con1, isolate 1, BK, EC1, EC10, HC-J2, HC-J5; HC-J6, HC-J7, HC-J8, HC-JT, HCT18, HCT27, HCV-476, HCV-KF, "Hunan", "Japanese", "Taiwan", TH, type 1, type 1a, H77 type 1b, type 1c, type 1d, type 1e, type 1f, type 10, type 2, type 2a, type 2b, type 2c, type 2d, type 2f, type 3, type 3a, type 3b, type 3g, type 4, type 4a, type 4c, type 4d, type 4f, type 4h, type 4k, type 5, type 5a, type 6 and type 6a.

The terms "individual," "host," "subject," and "patient" are used interchangeably herein, and refer to a mammal, including, but not limited to, non-human primates (e.g., simians), equines (e.g., horses), and humans.

As used herein, the term "isolated," in reference to a polypeptide, refers to a polypeptide that is in an environment different from that in which the polypeptide naturally occurs. An isolated polypeptide can be purified. By "purified" is meant a compound of interest (e.g., a polypeptide) has been separated from components that accompany it in nature. "Purified" can also be used to refer to a polypeptide separated from components that can accompany it during production of the polypeptide (e.g., during synthesis in vitro, etc.). In some embodiments, a polypeptide (or a mixture of polypeptides) is substantially pure when the polypeptide (or mixture of polypeptides) is at least 60% or at least 75% by weight free from organic molecules with which it is naturally associated or with which it is associated during production. In some embodiments, the polypeptide is from 30% to 60% pure. In some embodiments, the polypeptide (or mixture of polypeptides) is at least 60%, at least 75%, at least 80%, at least 85%, at least 90%, at least 95%, or at least 99%, by weight, pure. For example, in some embodiments, an E1 or an E2 polypeptide (or a mixture of E1 and E2 polypeptides) is substantially pure when the E1 or E2 polypeptide (or mixture of E1 and E2 polypeptides) is at least 60% or at least 75% by weight free from organic molecules with which the polypeptide(s) is naturally associated or with which it is associated during production. In some embodiments, the E1 or E2 polypeptide (or mixture of E1 and E2 polypeptides) is at least 60%, at least 75%, at least 80%, at least 85%, at least 90%, at least 95%, or at least 99%, by weight, pure. In some embodiments, where a composition comprises an E2 polypeptide, the E2 polypeptide is at least 60%, at least 75%, at least 80%, at least 85%, at least 90%, at least 95%, or at least 99%, by weight, pure. In some embodiments, where a composition comprises an E1/E2 heterodimeric complex polypeptide, the E1/E2 heterodimeric complex polypeptide is at least 60%, at least 75%, at least 80%, at least 85%, at least 90%, at least 95%, or at least 99%, by weight, pure. In some embodiments, where a composition comprises an E1/variant E2 heterodimeric complex polypeptide, the E1/variant E2 heterodimeric complex polypeptides are at least 60%, at least 75%, at least 80%, at least 85%, at least 90%, at least 95%, or at least 99%, by weight, pure. In some embodiments, where a composition comprises a variant E1/E2 heterodimeric complex polypeptide, the variant E1/E2 heterodimeric complex polypeptides are at least 60%, at least 75%, at least 80%, at least 85%, at least 90%, at least 95%, or at least 99%, by weight, pure. In some embodiments, where a composition comprises a variant E1/variant E2 heterodimeric complex polypeptide, the variant E1/variant E2 heterodimeric complex polypeptides are at least 60%, at least 75%, at least 80%, at least 85%, at least 90%, at least 95%, or at least 99%, by weight, pure. In some embodiments, where a composition comprises a variant E1 polypeptide, the variant E1 polypeptide is at least 60%, at least 75%, at least 80%, at least 85%, at least 90%, at least 95%, or at least 99%, by weight, pure. In some embodiments, where a composition comprises a variant E2 polypeptide, the variant E2 polypeptide is at least 60%, at least 75%, at least 80%, at least 85%, at least 90%, at least 95%, or at least 99%, by weight, pure.

The terms "polynucleotide" and "nucleic acid," used interchangeably herein, refer to a polymeric form of nucleotides of any length, either ribonucleotides or deoxyribonucleotides. Thus, this term includes, but is not limited to, single-, double-, or multi-stranded DNA or RNA, genomic DNA, cDNA, DNA-RNA hybrids, or a polymer comprising purine and pyrimidine bases or other natural, chemically or biochemically modified, non-natural, or derivatized nucleotide bases. In some cases, a polynucleotide is RNA. In some cases, a polynucleotide is DNA. A "polynucleotide" includes a nucleic acid that is incorporated into a viral vector or a bacterial vector.

The terms "peptide," "polypeptide," and "protein" are used interchangeably herein, and refer to a polymeric form of amino acids of any length, which can include coded and non-coded amino acids, chemically or biochemically modified or derivatized amino acids, and polypeptides having modified peptide backbones. The term "polypeptide" includes glycosylated polypeptides.

The term "heterologous" refers to two components that are defined by structures derived from different sources. For example, where "heterologous" is used in the context of a polypeptide, where the polypeptide includes operably linked amino acid sequences that can be derived from one or more different polypeptides, e.g., amino acid sequences that are not operably linked to the polypeptide in nature.

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise. Thus, for example, reference to "a variant HCV E2 polypeptide" includes a plurality of such polypeptides and reference to "the HCV E1 polypeptide" includes reference to one or more HCV E1 polypeptides and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub-combination was individually and explicitly disclosed herein.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

DETAILED DESCRIPTION

T cell responses and antibody responses to HCV can be protective against HCV infection. The present disclosure provides heterodimeric polypeptides comprising: 1) a variant hepatitis C virus (HCV) E2 polypeptide and an HCV E1 polypeptide; 2) a variant HCV E1 polypeptide and an HCV E2 polypeptide; and 3) a variant HCV E1 polypeptide and a variant HCV E2 polypeptide, where the variant HCV E2 polypeptide and/or or the HCV E1 polypeptide comprises a heterologous polypeptide comprising one or more T cell epitopes, e.g., one or more T cell epitopes present in an HCV polypeptide other than an HCV E1 polypeptide or an HCV E2 polypeptide, where the one or more T-cell epitopes are referred to as a "polytope." Inclusion of T cell epitopes provides for a more robust T-cell response to HCV, including cytotoxic $CD8^+$ T-cell responses to HCV-infected cells, and $CD4^+$ T helper responses. Enhanced $CD4^+$ responses may also result in a higher titer of neutralizing anti-E1/E2 antibodies to HCV. Such T-cell responses and antibody titers can provide a protective response against HCV infection. The T-cell epitopes that are included within the polytope can include conserved T-cell epitopes and/or immunodominant T-cell epitopes. It was found that inclusion, in an HCV E2 polypeptide, of a heterologous polypeptide comprising a polytope (one or more T-cell epitopes) allows formation of an E1/E2 heterodimer. A purification scheme was devised, which provides for ease of production of E1/E2 heterodimers (where one or both of the E1 and E2 polypeptides comprises a heterologous polypeptide comprising one or more T-cell epitopes), and which provides for highly purified E1/E2 heterodimers using a scaleable vaccine manufacturing level process.

E1/E2 heterodimers of the present disclosure provide improvements to previously-described vaccine candidates by 1) eliciting higher levels of HCV-specific CD4+ T helper responses, which are known to contribute to protection against HCV infection; 2) eliciting higher levels of HCV-specific CD8+ cytotoxic T cell responses, which are known to contribute to protection against HCV infection; and 3) via the inclusion of extra CD4+ T helper epitopes, leading to higher titers of HCV neutralizing antibodies which are also known to be associated with protection against HCV infection.

A variant E2 polypeptide, also referred to as an "E2 fusion polypeptide," comprises an HCV E2 polypeptide and a heterologous polypeptide, where the heterologous polypeptide is also referred to as a "fusion partner." The heterologous polypeptide is covalently linked to the HCV E2 polypeptide. A variant E1 polypeptide, also referred to as an "E1 fusion polypeptide," comprises an HCV E1 polypeptide and a heterologous polypeptide, where the heterologous polypeptide is also referred to as a "fusion partner." The heterologous polypeptide is covalently linked to the HCV E1 polypeptide. The heterologous polypeptide ("fusion partner") comprises one or more T-cell epitopes present in an HCV polypeptide other than an HCV E1 polypeptide or an HCV E2 polypeptide. The heterologous polypeptide can be fused to the N-terminus or the C-terminus of the HCV E1 or HCV E2 polypeptide.

The present disclosure provides heterodimeric polypeptides comprising a variant HCV E2 polypeptide and an HCV E1 polypeptide, or comprising a variant HCV E1 polypeptide and an HCV E2 polypeptide, or comprising a variant HCV E1 polypeptide and a variant HCV E2 polypeptide, where the variant HCV E2 polypeptide and/or the HCV E1 polypeptide comprises a heterologous polypeptide comprising one or more T cell epitopes, e.g., one or more T cell epitopes present in an HCV polypeptide other than an HCV E1 polypeptide or an HCV E2 polypeptide. The present disclosure provides nucleic acids encoding a polyprotein that includes E1 and variant E2, or that includes E2 and variant E1, or that includes variant E2 and variant E1. The present disclosure provides a method of producing an E1/E2 heterodimer of the present disclosure. The present disclosure also provides variant E2 polypeptides and variant E1 polypeptides; and nucleic acids encoding the variant polypeptides. The present disclosure provides a method of inducing an immune response in an individual. The present disclosure provides a method of inducing an immune response (e.g., a protective immune response) to HCV antigens in an individual. The present disclosure provides a method of inducing a protective immune response to one or more HCV genotypes in an individual. In some cases, the HCV E2 polypeptide is an HCV E2 ectodomain polypeptide. In some cases, the HCV E2 polypeptide is a full-length HCV E2 polypeptide. In some cases, the HCV E1 polypeptide is an HCV E1 ectodomain polypeptide. In some cases, the HCV E1 polypeptide is a full-length HCV E1 polypeptide.

The present disclosure provides heterodimeric polypeptides comprising: a) a variant HCV E2 polypeptide and an HCV E1 polypeptide; b) a variant HCV E1 polypeptide and an HCV E2 polypeptide; or c) a variant HCV E1 polypeptide and a variant HCV E2 polypeptide, where the variant HCV E2 polypeptide or the HCV E1 polypeptide comprises one or more T cell epitopes, e.g., one or more T cell epitopes present in an HCV polypeptide other than an HCV E1 polypeptide or an HCV E2 polypeptide. The one or more T-cell epitopes can include one or more T-cell epitopes present in: a) an HCV non-structural polypeptide-3 (NS3) polypeptide; b) an HCV non-structural polypeptide-2 (NS2) polypeptide; c) an HCV non-structural polypeptide-4A (NS4A) polypeptide; d) an HCV non-structural polypeptide-4B (NS4B) polypeptide; e) an HCV non-structural polypeptide-5A (NS5A) polypeptide; f) an HCV non-structural polypeptide-5B (NS5B) polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein. Thus, in some cases, a variant HCV E1 polypeptide or variant HCV E2 polypeptide of an E1/E2 heterodimer of the present disclosure includes: a) an HCV E1 polypeptide or an HCV E2 polypeptide; and b) a heterologous polypeptide that comprises one or more T-cell epitopes, where the one or more T-cell epitopes are T-cell epitopes present in: i) one or more of an HCV NS3 polypeptide, an HCV NS2 polypeptide, an HCV NS4A polypeptide, an HCV NS4B polypeptide, an HCV NS5A polypeptide, an HCV NS5B polypeptide, an HCV core polypeptide, and an HCV p7 polypeptide; and ii) one or more of cholera toxin or toxoid, tetanus toxin or toxoid, diphtheria toxin or toxoid, and a meningococcal outer membrane protein.

In some cases, a heterodimeric polypeptide of the present disclosure includes: a) an HCV E1 polypeptide; and b) a variant HCV E2 polypeptide comprising: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein. In some cases, a variant HCV E2 polypeptide of an E1/E2 heterodimer of the present disclosure includes: a) an HCV E2 polypeptide; and b) a heterologous polypeptide that comprises one or more T-cell epitopes, where the one or more T-cell epitopes are T-cell epitopes present in: i) one or more of an HCV NS3 polypeptide, an HCV NS2 polypeptide, an HCV NS4A polypeptide, an HCV NS4B polypeptide, an HCV NS5A polypeptide, an HCV NS5B polypeptide, an HCV core polypeptide, and an HCV p7 polypeptide; and ii) one or more of cholera toxin or toxoid, tetanus toxin or toxoid, diphtheria toxin or toxoid, and a meningococcal outer membrane protein In some cases, a heterodimeric polypeptide of the present disclosure includes: a) a variant HCV E1 polypeptide comprising: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide); and b) an HCV E2 polypeptide. The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein. In some cases, a variant HCV E1 polypeptide of an E1/E2 heterodimer of the present disclosure includes: a) an HCV E1 polypeptide; and b) a heterologous polypeptide that comprises one or more T-cell epitopes, where the one or more T-cell epitopes are T-cell epitopes present in: i) one or more of an HCV NS3 polypeptide, an HCV NS2 polypeptide, an HCV NS4A polypeptide, an HCV NS4B polypeptide, an HCV NS5A polypeptide, an HCV NS5B polypeptide, an HCV core polypeptide, and an HCV p7 polypeptide; and ii) one or more of cholera toxin or toxoid, tetanus toxin or toxoid, diphtheria toxin or toxoid, and a meningococcal outer membrane protein.

In some cases, a heterodimeric polypeptide of the present disclosure includes: a) a variant HCV E1 polypeptide comprising: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide); and b) a variant HCV E2 polypeptide comprising: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein. In some cases, a variant HCV E2 and a variant HCV E1 polypeptide of an E1/E2 heterodimer of the present disclosure includes: 1) a) an HCV E2 polypeptide; and b) a heterologous polypeptide that comprises one or more T-cell epitopes, where the one or more T-cell epitopes are T-cell epitopes present in: i) one or more of an HCV NS3 polypeptide, an HCV NS2 polypeptide, an HCV NS4A polypeptide, an HCV NS4B polypeptide, an HCV NS5A polypeptide, an HCV NS5B polypeptide, an HCV core polypeptide, and an HCV p7 polypeptide; and ii) one or more of cholera toxin or toxoid, tetanus toxin or toxoid, diphtheria toxin or toxoid, and a meningococcal outer membrane protein; and 2) a) an HCV E1 polypeptide; and b) a heterologous polypeptide that comprises one or more T-cell epitopes, where the one or more T-cell epitopes are T-cell epitopes present in: i) one or more of an HCV NS3 polypeptide, an HCV NS2 polypeptide, an HCV NS4A polypeptide, an HCV NS4B polypeptide, an HCV NS5A polypeptide, an HCV NS5B polypeptide, an HCV core polypeptide, and an HCV p7 polypeptide; and ii) one or more of cholera toxin or toxoid, tetanus toxin or toxoid, diphtheria toxin or toxoid, and a meningococcal outer membrane protein.

As noted above, the present disclosure provides heterodimeric polypeptides comprising: a) a variant HCV E2 polypeptide and an HCV E1 polypeptide; b) a variant HCV E1 polypeptide and an HCV E2 polypeptide; or c) a variant HCV E1 polypeptide and a variant HCV E2 polypeptide, where the variant HCV E2 polypeptide or the HCV E1 polypeptide comprises one or more T cell epitopes, e.g., one or more T cell epitopes present in an HCV polypeptide other than an HCV E1 polypeptide or an HCV E2 polypeptide. The presence of the one or more T-cell epitopes (e.g., one or more T-cell epitopes conserved among the hepacivirus genus; e.g., one or more immunodominant T-cell epitopes) provides for a more robust cellular immune response (e.g., a $CD4^+$ and/or a $CD8^+$ immune response) to HCV than a wild-type HCV E1/E2 heterodimer. For example, the addition of the one or more T-cell epitopes provides for a more robust $CD4^+$ helper and $CD8^+$ cytotoxic T cell response to HCV than a wild-type HCV E1/E2 heterodimer, and provides greater T helper activity to promote stronger antibody responses to the E1/E2 heterodimer. These features provide for superior HCV vaccine antigens.

The present disclosure provides variant HCV E2 polypeptides, and variant HCV E1 polypeptides. A variant E2 polypeptide of the present disclosure heterodimerizes with an HCV E1 polypeptide. A variant E1 polypeptide of the present disclosure heterodimerizes with an HCV E2 polypeptide. The heterodimer, or a polynucleotide(s) comprising a nucleotide sequence encoding the heterodimer, can be used to induce an immune response against HCV in an individual. For example, the heterodimer, or a polynucleotide(s) comprising a nucleotide sequence encoding the heterodimer, can be used to induce a protective immune response against HCV in an individual. In some cases, the heterodimer, or a polynucleotide(s) comprising a nucleotide sequence encoding the heterodimer, can be used to induce a protective immune response against HCV of more than one genotype.

Suitable T-cell epitopes (e.g., one or more conserved T-cell epitopes; e.g., one or more immunodominant T-cell epitopes) are described in detail below; and in the Figures. Suitable T-cell epitopes can be identified using the methods described in the Examples section, or using any other method that identifies conserved T-cell epitiopes or immunodominant T-cell epitopes.

In some cases, a heterologous polypeptide present in a variant E1 polypeptide or a variant E2 polypeptide described herein, where the heterologous polypeptide comprises one or more T-cell epitopes present in an HCV polypeptide other than an HCV E1 polypeptide or an HCV E2 polypeptide, comprises: a) two or more (2, 3, 4, 5, 6, 7, 8, 9, or 10, or more than 10) T cell epitopes of an HCV NS3 polypeptide; b) two or more (2, 3, 4, 5, 6, 7, 8, 9, or 10, or more than 10) T cell epitopes of an HCV NS2 polypeptide; c) two or more (2, 3, 4, 5, 6, 7, 8, 9, or 10, or more than 10) T cell epitopes of an HCV NS4A polypeptide; d) two or more (2, 3, 4, 5, 6, 7, 8, 9, or 10, or more than 10) T cell epitopes of an HCV NS4B polypeptide; e) two or more (2, 3, 4, 5, 6, 7, 8, 9, or 10, or more than 10) T cell epitopes of an HCV NS5A polypeptide; f) two or more (2, 3, 4, 5, 6, 7, 8, 9, or 10, or more than 10) T cell epitopes of an HCV NS5B polypeptide; g) two or more (2, 3, 4, 5, 6, 7, 8, 9, or 10, or more than 10) T cell epitopes of an HCV core polypeptide; h) two or more (2, 3, 4, 5, 6, 7, 8, 9, or 10, or more than 10) T cell epitopes of an HCV p7 polypeptide; i) one or more T-cell epitopes of an HCV NS3 polypeptide and one or more T-cell epitopes of an HCV NS2 polypeptide; j) one or more T-cell epitopes of an HCV NS3 polypeptide and one or more T-cell epitopes of an HCV NS4B polypeptide; k) one or more T-cell epitopes of an HCV NS3 polypeptide and one or more T-cell epitopes of an HCV NS5A polypeptide; l) one or more T-cell epitopes of an HCV NS3 polypeptide and one or more T-cell epitopes of an HCV NS5B polypeptide; m) one or more T-cell epitopes of an HCV NS3 polypeptide and one or more T-cell epitopes of an HCV core polypeptide; n) one or more T-cell epitopes of an HCV NS3 polypeptide, one or more T-cell epitopes of an HCV NS2 polypeptide, and one or more T-cell epitopes of an HCV core polypeptide; o) one or more T-cell epitopes of an HCV NS3 polypeptide, one or more T-cell epitopes of an HCV NS2 polypeptide, and one or more T-cell epitopes of an HCV NS4B polypeptide; or p) one or more T-cell epitopes of an HCV NS3 polypeptide, one or more T-cell epitopes of an HCV NS2 polypeptide, and one or more T-cell epitopes of an HCV NS5A polypeptide. Other combinations are possible and are contemplated by the present disclosure.

In some cases, a variant E2 polypeptide and/or a variant E1 polypeptide comprises a heterologous polypeptide comprising a polytope that comprises: 1) a contiguous NS3-NS4a polypeptide in which the NS3-encoded serine protease is rendered inactive by mutation of any one of the catalytic triad amino acids (H,D,S); 2) a contiguous NS3-NS4a-NS4a polypeptide in which the NS3-encoded serine protease is rendered inactive by mutation of any one of the catalytic triad amino acids (H,D,S); 3) a contiguous NS3-NS4a-NS4a-NS5a polypeptide in which the NS3-encoded serine protease is rendered inactive by mutation of any one of the catalytic triad amino acids (H,D,S); or 4) a contiguous NS3-NS4a-NS4a-NS5a-NS5a polypeptide in which the NS3-encoded serine protease is rendered inactive by mutation of any one of the catalytic triad amino acids (H,D,S) and the NS5b-encoded RNA polymerase is rendered inactive by mutation of any residues in the GDD motif that is required for polymerase activity.

In some cases, a linker can be interposed between the heterologous polypeptide ("polytope") and the HCV E1 or HCV E2 polypeptide. The linker peptide may have any of a variety of amino acid sequences. A linker can be a peptide of between about 6 and about 40 amino acids in length, or between about 6 and about 25 amino acids in length. These linkers can be produced by using synthetic, linker-encoding oligonucleotides to couple the proteins. Peptide linkers allowing a degree of flexibility can be used. The linking peptides may have virtually any amino acid sequence, bearing in mind that suitable linkers will have a sequence that results in a generally flexible peptide. The use of small amino acids, such as glycine and alanine, are of use in creating a flexible peptide. The creation of such sequences is routine to those of skill in the art.

Suitable linkers can be readily selected and can be of any of a suitable of different lengths, such as from 1 amino acid (e.g., Gly, Ala, or Ser) to 20 amino acids, from 2 amino acids to 15 amino acids, from 3 amino acids to 12 amino acids, including 4 amino acids to 10 amino acids, 5 amino acids to 9 amino acids, 6 amino acids to 8 amino acids, or 7 amino acids to 8 amino acids, and may be 1, 2, 3, 4, 5, 6, or 7 amino acids.

Exemplary flexible linkers include glycine polymers $(G)_n$, glycine-serine polymers (including, for example, $(GS)_n$, $(GSGGS)_n$ (SEQ ID NO:55) and $(GGGS)_n$ (SEQ ID NO:56), where n is an integer of at least one), glycine-alanine polymers, alanine-serine polymers, and other flexible linkers known in the art. Glycine and glycine-serine polymers are of interest since both of these amino acids are relatively unstructured, and therefore may serve as a neutral tether between components. Glycine polymers are of particular interest since glycine accesses significantly more phi-psi space than even alanine, and is much less restricted than residues with longer side chains (see Scheraga, *Rev. Computational Chem.* 11173-142 (1992)). Exemplary flexible linkers include, but are not limited to, GGSG (SEQ ID NO:57), GGSGG (SEQ ID NO:58), GSGSG (SEQ ID NO:59), GSGGG (SEQ ID NO:60), GGGSG (SEQ ID NO:61), GSSSG (SEQ ID NO:62), and the like. The ordinarily skilled artisan will recognize that design of a peptide conjugated to any elements described above can include linkers that are all or partially flexible, such that the linker can include a flexible linker as well as one or more portions that confer less flexible structure.

I. E1/E2 Heterodimers

The present disclosure provides heterodimeric polypeptides comprising: a) a variant HCV E2 polypeptide and an HCV E1 polypeptide; b) a variant HCV E1 polypeptide and an HCV E2 polypeptide; or c) a variant HCV E1 polypeptide and a variant HCV E2 polypeptide, where the variant HCV E2 polypeptide or the HCV E1 polypeptide comprises one or more T cell epitopes, e.g., one or more T cell epitopes present in an HCV polypeptide other than an HCV E1 polypeptide or an HCV E2 polypeptide.

An E1/E2 heterodimer of the present disclosure, or a nucleic acid(s) (e.g., one or more recombinant expression vectors; an mRNA molecule(s); a DNA molecule(s)) comprising a nucleotide sequence encoding the E1/E2 heterodimer, can be used to induce an immune response to HCV in an individual. The nucleic acid may be in the form of DNA or RNA, or may be complexed with a polymer such as poly-lactic-co-glycolide (PLG) or liposomal formulations or may be inserted into a viral vaccine vector or bacterial vaccine vectors. Nucleic acid vaccines are feasible using either viral or bacterial vectors to deliver the nucleic acids encoding vaccine antigens or by delivering the encoding DNA or RNA into an immunogenic vaccine formulation (Deering et al. (2014) *Expert Opin Drug Deliv.* 11(6):885-99).

IA. E1E2 Heterodimers Comprising HCV E1 and a Variant HCV E2

The present disclosure provides an E1/E2 heterodimer, where the E1/E2 heterodimer comprises: a) a variant HCV E2 polypeptide, where the variant HCV E2 polypeptide comprises: i) an HCV E2 polypeptide; and ii) a heterologous polypeptide that comprises one or more T-cell epitopes (e.g., one or more T-cell epitopes not present in an HCV E1 or an HCV E2 polypeptide; e.g., one or more T-cell epitopes present in an HCV polypeptide other than an HCV E1 or an HCV E2 polypeptide); and b) an HCV E1 polypeptide. Thus, in some cases, a heterodimeric polypeptide of the present disclosure includes: a) an HCV E1 polypeptide; and b) a variant HCV E2 polypeptide comprising: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein. The heterologous polypeptide is also referred to as a "polytope."

An E1/E2 heterodimer of the present disclosure (e.g., an E1/E2 heterodimer comprising: a) an HCV E1 polypeptide; and b) a variant HCV E2 polypeptide comprising: i) an HCV E2 polypeptide; and ii) a heterologous polypeptide comprising one or more T-cell epitopes), when administered to an individual in need thereof, induces an immune response in the individual to one or more HCV genotypes. An E1/E2 heterodimer of the present disclosure, when administered to an individual in need thereof, induces an immune response in the individual to one or more HCV genotypes, where the immune response is greater than the immune response induced by administration of an HCV E1/E2 heterodimer comprising a wild-type E1 and a wild-type E2 polypeptide or an E2 polypeptide lacking the polytope.

For example, in some cases, an E1/E2 heterodimer of the present disclosure (e.g., an E1/E2 heterodimer comprising: a) an HCV E1 polypeptide; and b) a variant HCV E2 polypeptide comprising: i) an HCV E2 polypeptide; and ii) a heterologous polypeptide comprising one or more T-cell epitopes), when administered to an individual in need thereof, induces cytotoxic T lymphocytes (CTLs) specific for HCV, where the number of HCV-specific CTLs induced is at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, higher than the number of HCV-specific CTLs induced by administration of an HCV E1/E2 heterodimer comprising a wild-type E1 and a wild-type E2 polypeptide or an E2 polypeptide lacking the polytope.

In some cases, an E1/E2 heterodimer of the present disclosure (e.g., an E1/E2 heterodimer comprising: a) an HCV E1 polypeptide; and b) a variant HCV E2 polypeptide comprising: i) an HCV E2 polypeptide; and ii) a heterologous polypeptide comprising one or more T-cell epitopes present in an HCV polypeptide other than an HCV E1 polypeptide or an HCV E2 polypeptide), when administered to an individual in need thereof, induces production of HCV-specific $CD4^+$ T cells and $CD8^+$ T cells in the individual, where the number of HCV-specific $CD4^+$ T cells and $CD8^+$ T cells is increased, such that the percent of the total peripheral blood T cells (i.e., the total number of $CD4^+$ T cells+$CD8^+$ T cells in the peripheral blood) that are HCV-specific $CD4^+$ T cells and $CD8^+$ T cells is from 0.05% to 10% (e.g., from 0.05% to 0.1%, from 0.1% to 0.5%, from 0.5% to 1%, from 1% to 2%, from 2% to 5%, or from 5% to 10%). The number of HCV-specific $CD4^+$ T cells and $CD8^+$ T cells in a control individual (e.g., an individual not infected with HCV) not treated with the E1/E2 heterodimer would be undetectable.

For example, in some cases, an E1/E2 heterodimer of the present disclosure (e.g., an E1/E2 heterodimer comprising: a) an HCV E1 polypeptide; and b) a variant HCV E2 polypeptide comprising: i) an HCV E2 polypeptide; and ii) a heterologous polypeptide comprising one or more HCV NS3 T-cell epitopes), when administered to an individual in need thereof, induces production of HCV NS3-specific $CD4^+$ T cells and $CD8^+$ T cells in the individual, where the number of HCV NS3-specific $CD4^+$ T cells and $CD8^+$ T cells is increased, such that the percent of the total peripheral blood T cells (i.e., the total number of $CD4^+$ T cells+$CD8^+$ T cells in the peripheral blood) that are HCV NS3-specific $CD4^+$ T cells and $CD8^+$ T cells is from 0.05% to 10% (e.g., from 0.05% to 0.1%, from 0.1% to 0.5%, from 0.5% to 1%, from 1% to 2%, from 2% to 5%, or from 5% to 10%). The number of HCV NS3-specific $CD4^+$ T cells and $CD8^+$ T cells in a control individual (e.g., an individual not infected with HCV) not treated with the E1/E2 heterodimer would be undetectable.

In some cases, an E1/E2 heterodimer of the present disclosure (e.g., an E1/E2 heterodimer comprising: a) an HCV E1 polypeptide; and b) a variant HCV E2 polypeptide comprising: i) an HCV E2 polypeptide; and ii) a heterologous polypeptide comprising one or more T-cell epitopes present in an HCV polypeptide other than an HCV E1 polypeptide or an HCV E2 polypeptide), when administered to an individual in need thereof, increases the number of HCV E1/E2-specific $CD4^+$ T cells and $CD8^+$ T cells in the individual by at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, compared to the number of HCV E1/E2-specific $CD4^+$ T cells and $CD8^+$ T cells in the individual induced by administration of an E1/E2 heterodimer comprising a wild-type E1 polypeptide and a wild-type E2 polypeptide, or an E2 polypeptide lacking the polytope, or compared to the number of HCV E1/E2-specific $CD4^+$ T cells and $CD8^+$ T cells in the individual before administration of the E1/E2 heterodimer of the present disclosure.

As another example, in some cases, an E1/E2 heterodimer of the present disclosure (e.g., an E1/E2 heterodimer comprising: a) an HCV E1 polypeptide; and b) a variant HCV E2 polypeptide comprising: i) an HCV E2 polypeptide; and ii) a heterologous polypeptide comprising one or more T-cell epitopes present in an HCV polypeptide other than an HCV E1 polypeptide or an HCV E2 polypeptide), when administered to an individual in need thereof, induces helper T lymphocytes (e.g., $CD4^+$ T cells) specific for HCV, where the number of HCV-specific helper T cells induced is at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, higher than the number of HCV-specific helper T cells induced by administration of an E1/E2 heterodimer comprising a wild-type E1 polypeptide and a wild-type E2 polypeptide, or an E2 polypeptide lacking the polytope, or compared to the number of HCV-specific helper T cells in the individual before administration of the E1/E2 heterodimer of the present disclosure.

In some cases, an E1/E2 heterodimer of the present disclosure (e.g., an E1/E2 heterodimer comprising: a) an HCV E1 polypeptide; and b) a variant HCV E2 polypeptide comprising: i) an HCV E2 polypeptide; and ii) a heterologous polypeptide comprising one or more T-cell epitopes present in an HCV polypeptide other than an HCV E1 polypeptide or an HCV E2 polypeptide), when administered to an individual in need thereof, induces antibody specific for HCV (e.g., anti-E1/E2 antibody), where the level of HCV-specific antibody induced is at least at high as the level of HCV-specific antibody induced by administration of an E1/E2 heterodimer comprising a wild-type E1 polypeptide and a wild-type E2 polypeptide, or an E2 polypeptide lacking the polytope.

In some cases, an E1/E2 heterodimer of the present disclosure (e.g., an E1/E2 heterodimer comprising: a) an HCV E1 polypeptide; and b) a variant HCV E2 polypeptide comprising: i) an HCV E2 polypeptide; and ii) a heterologous polypeptide comprising one or more T-cell epitopes present in an HCV polypeptide other than an HCV E1 polypeptide or an HCV E2 polypeptide), when administered to an individual in need thereof, induces antibody specific for HCV (e.g., anti-E1/E2 antibody), where the level of HCV-specific antibody induced is at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, higher than the level of HCV-specific antibody induced by administration of an E1/E2 heterodimer comprising a wild-type E1 polypeptide and a wild-type E2 polypeptide, or an E2 polypeptide lacking the polytope.

An E1/E2 heterodimer of the present disclosure (e.g., an E1/E2 heterodimer comprising: a) an HCV E1 polypeptide; and b) a variant HCV E2 polypeptide comprising: i) an HCV E2 polypeptide; and ii) a heterologous polypeptide comprising one or more T-cell epitopes present in an HCV polypeptide other than an HCV E1 polypeptide or an HCV E2 polypeptide), when administered to an individual in need thereof, induces an immune response (e.g., a cellular immune response) in the individual to one or more HCV genotypes. In some cases, an E1/E2 heterodimer of the present disclosure (e.g., an E1/E2 heterodimer comprising: a) an HCV E1 polypeptide; and b) a variant HCV E2 polypeptide comprising: i) an HCV E2 polypeptide; and ii) a heterologous polypeptide comprising one or more T-cell epitopes present in an HCV polypeptide other than an HCV E1 polypeptide or an HCV E2 polypeptide), when administered to an individual in need thereof, induces an immune response in the individual to HCV genotype 1. In some cases, an E1/E2 heterodimer of the present disclosure (e.g., an E1/E2 heterodimer comprising: a) an HCV E1 polypeptide; and b) a variant HCV E2 polypeptide comprising: i) an HCV E2 polypeptide; and ii) a heterologous polypeptide comprising one or more T-cell epitopes present in an HCV polypeptide other than an HCV E1 polypeptide or an HCV E2 polypeptide), when administered to an individual in need thereof, induces an immune response in the individual to HCV genotype 2. In some cases, an E1/E2 heterodimer of the present disclosure (e.g., an E1/E2 heterodimer comprising: a) an HCV E1 polypeptide; and b) a variant HCV E2 polypeptide comprising: i) an HCV E2 polypeptide; and ii) a heterologous polypeptide comprising one or more T-cell epitopes present in an HCV polypeptide other than an HCV E1 polypeptide or an HCV E2 polypeptide), when administered to an individual in need thereof, induces an immune response in the individual to HCV genotype 3. In some cases, an E1/E2 heterodimer of the present disclosure (e.g., an E1/E2 heterodimer comprising: a) an HCV E1 polypeptide; and b) a variant HCV E2 polypeptide comprising: i) an HCV E2 polypeptide; and ii) a heterologous polypeptide comprising one or more T-cell epitopes present in an HCV polypeptide other than an HCV E1 polypeptide or an HCV E2 polypeptide), when administered to an individual in need thereof, induces an immune response in the individual to HCV genotype 1 and HCV genotype 3. In some cases, an E1/E2 heterodimer of the present disclosure (e.g., an E1/E2 heterodimer comprising: a) an HCV E1 polypeptide; and b) a variant HCV E2 polypeptide comprising: i) an HCV E2 polypeptide; and ii) a heterologous polypeptide comprising one or more T-cell epitopes present in an HCV polypeptide other than an HCV E1 polypeptide or an HCV E2 polypeptide), when administered to an individual in need thereof, induces an immune response in the individual to HCV genotype 1, HCV genotype 2, and HCV genotype 3. In some cases, an E1/E2 heterodimer of the present disclosure (e.g., an E1/E2 heterodimer comprising: a) an HCV E1 polypeptide; and b) a variant HCV E2 polypeptide comprising: i) an HCV E2 polypeptide; and ii) a heterologous polypeptide comprising one or more T-cell epitopes present in an HCV polypeptide other than an HCV E1 polypeptide or an HCV E2 polypeptide), when administered to an individual in need thereof, induces an immune response in the individual to HCV genotype 1, HCV genotype 2, HCV genotype 3, and HCV genotype 7. In some cases, an E1/E2 heterodimer of the present disclosure (e.g., an E1/E2 heterodimer comprising: a) an HCV E1 polypeptide; and b) a variant HCV E2 polypeptide comprising: i) an HCV E2 polypeptide; and ii) a heterologous polypeptide comprising one or more T-cell epitopes present in an HCV polypeptide other than an HCV E1 polypeptide or an HCV E2 polypeptide), when administered to an individual in need thereof, induces an immune response in the individual to 1, 2, 3, 4, 5, 6, or all, of HCV genotype 1, HCV genotype 2, HCV genotype 3, HCV genotype 4, HCV genotype 5, HCV genotype 6, and HCV genotype 7. In some cases, an E1/E2 heterodimer of the present disclosure (e.g., an E1/E2 heterodimer comprising: a) an HCV E1 polypeptide; and b) a variant HCV E2 polypeptide comprising: i) an HCV E2 polypeptide; and ii) a heterologous polypeptide comprising one or more T-cell epitopes present in an HCV polypeptide other than an HCV E1 polypeptide or an HCV E2 polypeptide), when administered to an individual in need thereof, induces an immune response in the individual to HCV genotype 1, HCV genotype 2, HCV genotype 3, HCV genotype 4, HCV genotype 5, HCV genotype 6, and HCV genotype 7.

Variant E2

As noted above, a variant E2 polypeptide of an HCV E1/E2 heterodimer of the present disclosure comprises: i) an HCV E2 polypeptide; and ii) a heterologous polypeptide comprising one or more T cell epitopes (e.g., one or more T-cell epitopes not present in an HCV E1 or an HCV E2 polypeptide; e.g., one or more T-cell epitopes present in an HCV polypeptide other than an HCV E1 or an HCV E2 polypeptide). In some cases, the variant HCV E2 polypeptide comprises, in order from amino terminus (N-terminus) to carboxyl terminus (C-terminus): i) an HCV E2 polypeptide; and ii) a heterologous polypeptide comprising one or more T cell epitopes. In some cases, the variant HCV E2 polypeptide comprises, in order from N-terminus to C-terminus: i) a heterologous polypeptide comprising one or more T cell epitopes; and ii) an HCV E2 polypeptide.

In some cases, a variant E2 polypeptide of an HCV E1/E2 heterodimer of the present disclosure comprises from 1 to 10 amino acids at the N-terminus of the variant E2 polypeptide, which 1 to 10 amino acids are part of a cleavable linker that remains following cleavage of a polyprotein precursor, as described below. For example, where the cleavable linker comprises the amino acid sequence LEVLFQGP (SEQ ID NO:5), the variant E2 polypeptide can comprise Gly-Pro residues at the N-terminus of the polypeptide, e.g., as depicted in FIG. 5A.

E2

An E2 polypeptide suitable for inclusion in a variant E2 polypeptide of an E1/E2 heterodimer of the present disclosure can have a length of from about 200 amino acids (aa) to about 250 aa, from about 250 aa to about 275 aa, from about 275 aa to about 300 aa, from about 300 aa to about 325 aa, from about 325 aa to about 350 aa, or from about 350 aa to about 365 aa. In some cases, an HCV E2 polypeptide suitable for inclusion in a variant E2 polypeptide of an E1/E2 heterodimer of the present disclosure is an HCV E2 ectodomain polypeptide. In some cases, an HCV E2 polypeptide suitable for inclusion in a variant E2 polypeptide of an E1/E2 heterodimer of the present disclosure is a full-length HCV E2 polypeptide.

Figure 2A:
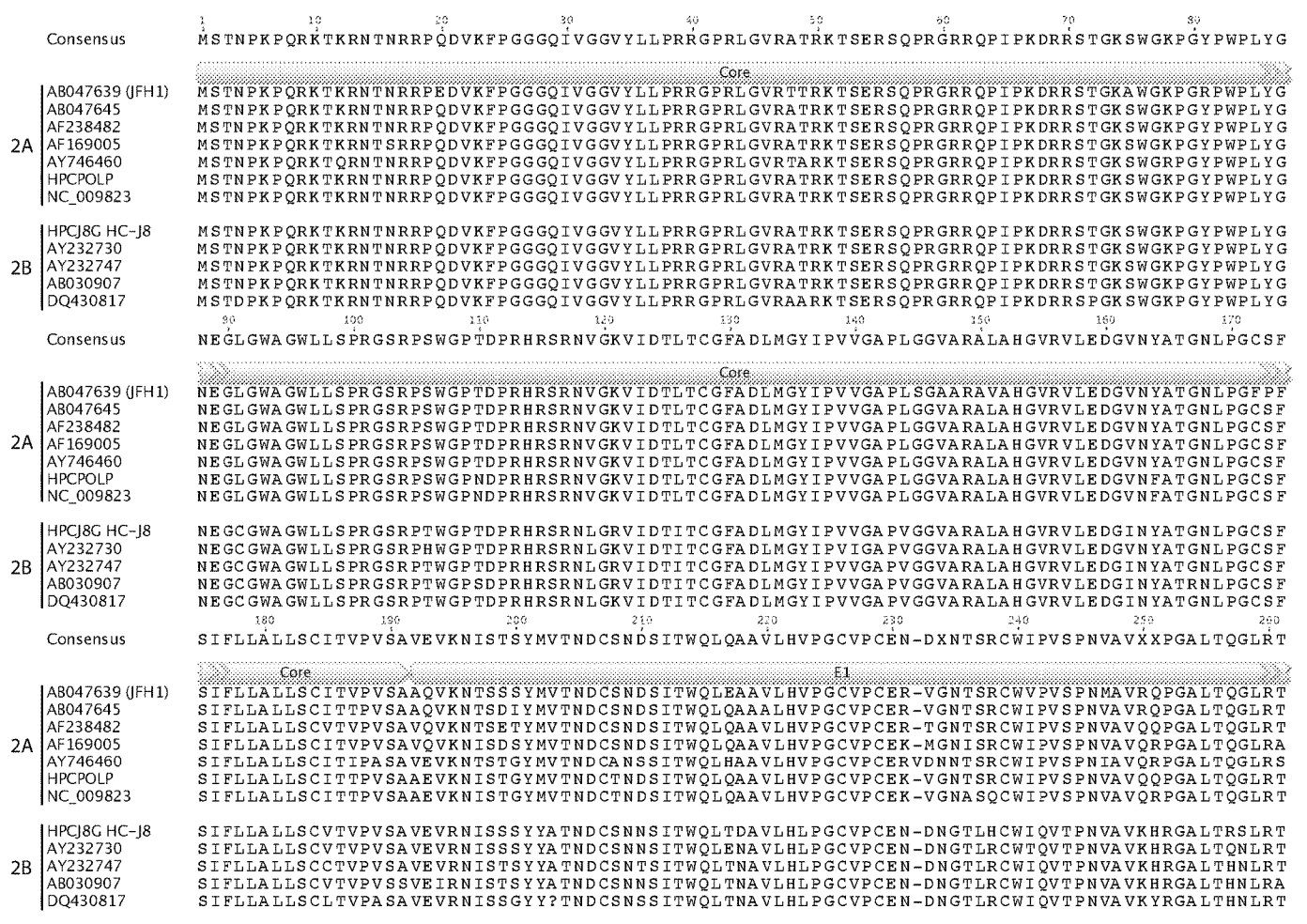
Figure 2B:
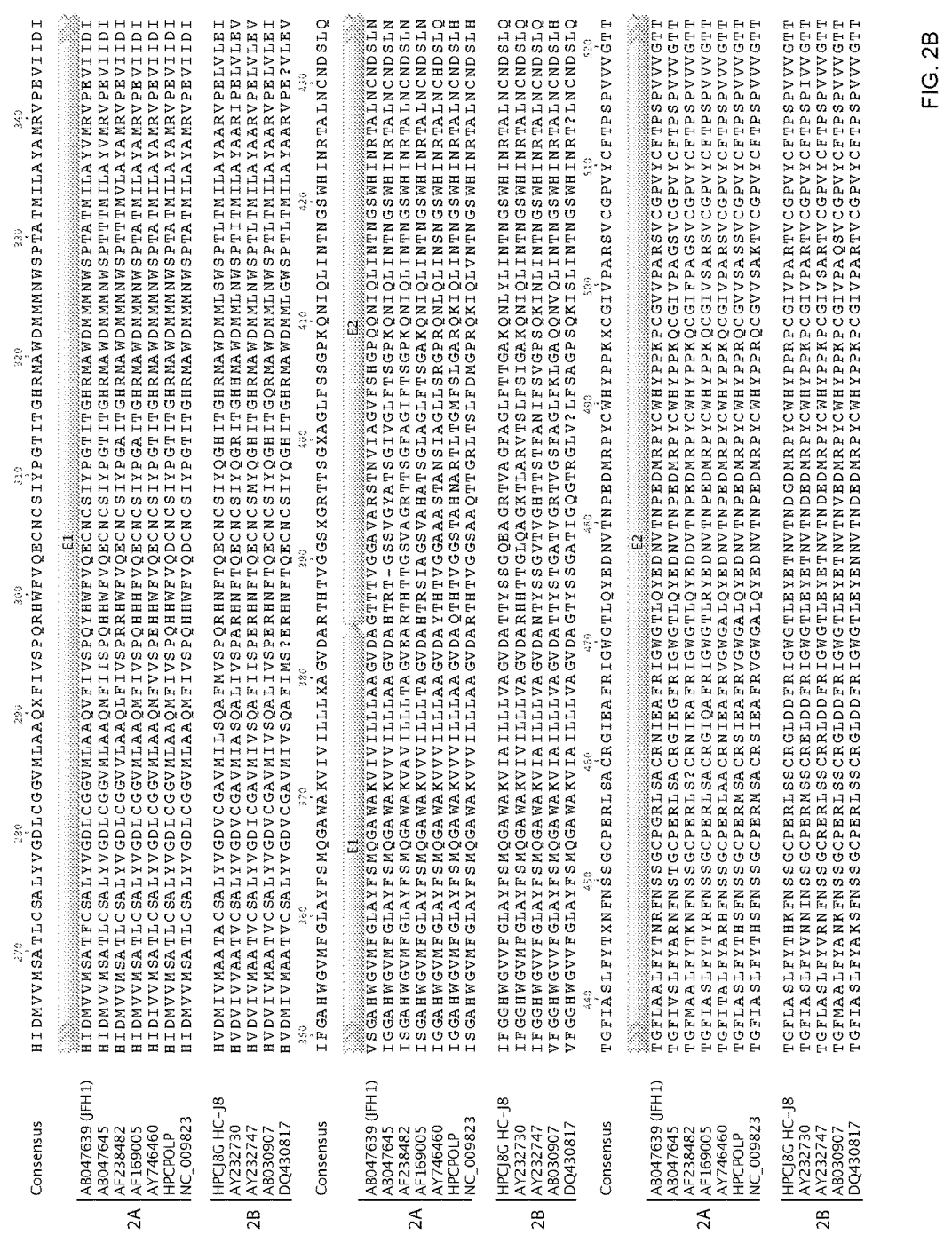

In FIGS. 1A-AC, the amino acid sequence of E2 is amino acid 384 to amino acid 746. In FIGS. 2A-2B, the amino acid sequence of E2 is amino acid 384 to amino acid 751. In FIGS. 3A-3C, the amino acid sequence of E2 is amino acid 385 to amino acid 754. In FIGS. 4A-4B, the amino acid sequence of E2 is amino acid 384 to amino acid 750. As used herein, an "E2 polypeptide" includes a precursor E2 protein, including the signal sequence; includes a mature E2 polypeptide which lacks this sequence; and includes an E2 polypeptide with a heterologous signal sequence. An E2 polypeptide can include a C-terminal membrane anchor sequence which occurs at approximately amino acid positions 715-730 and may extend as far as approximately amino acid residue 746 (see, Lin et al., J. Virol. (1994) 68:5063-5073).

Figure 1B:
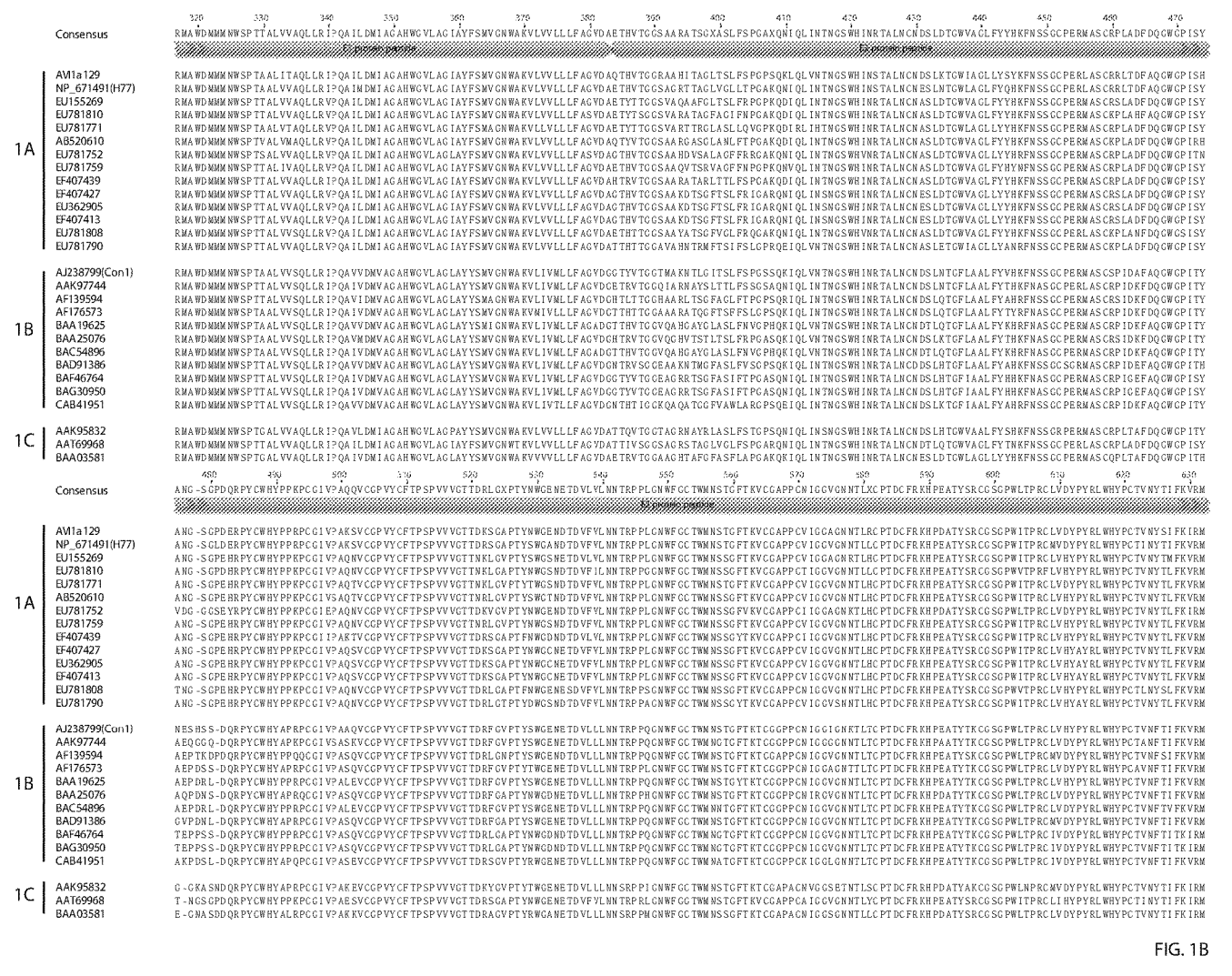
Figure 1C:
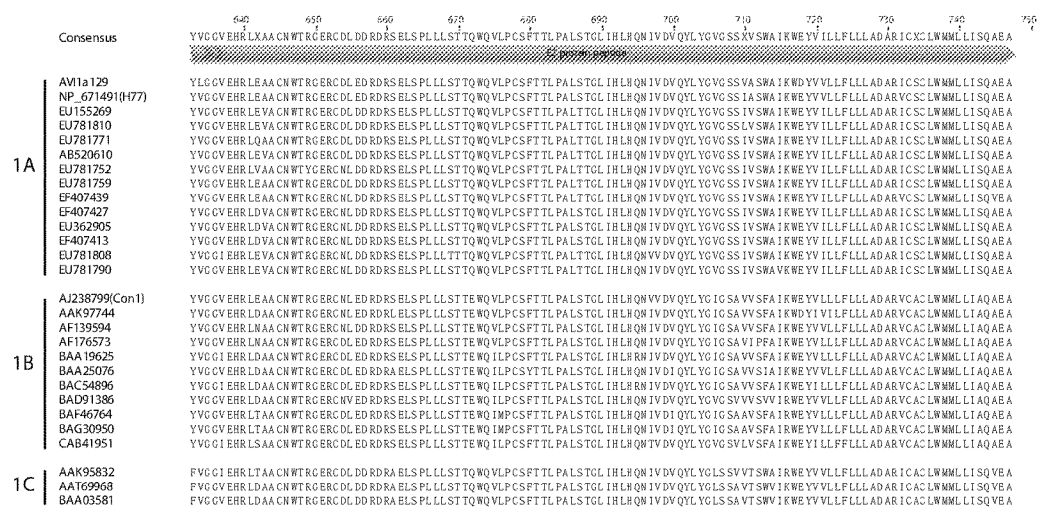

In some cases, a E2 polypeptide suitable for inclusion in a variant E2 polypeptide of an E1/E2 heterodimer of the present disclosure lacks a portion of its C-terminal region, e.g., from about amino acid 715 to the C-terminus; from about amino acid 625 to the C-terminus; from about amino acid 661 to the C-terminus; from about amino acid 655 to the C-terminus; from about amino acid 500 to the C-terminus, where the amino acid numbering is with reference to the numbering in FIGS. 1A-1C. See, e.g., U.S. Pat. No. 6,521,423.

An E2 polypeptide suitable for inclusion in a variant E2 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIGS. 1A-1C, FIGS. 2A-2C, FIGS. 3A-3C, or FIGS. 4A-4B. An E2 polypeptide suitable for inclusion in a variant E2 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, or at least about 75%, amino acid sequence identity to an amino acid sequence of an E2 polypeptide depicted in FIGS. 1A-1C, FIGS. 2A-2C, FIGS. 3A-3C, or FIGS. 4A-4B.

An E2 polypeptide suitable for inclusion in a variant E2 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIGS. 1A-1C. For example, an E2 polypeptide of genotype 1 can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence depicted in FIGS. 1A-1C. For example, an E2 polypeptide of genotype 1A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence identified as 1A and depicted in FIGS. 1A-1C. For example, an E2 polypeptide of genotype 1B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence identified as 1B and depicted in FIGS. 1A-1C. For example, an E2 polypeptide of genotype 1C can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence identified as 1C and depicted in FIGS. 1A-1C.

Figure 2C:
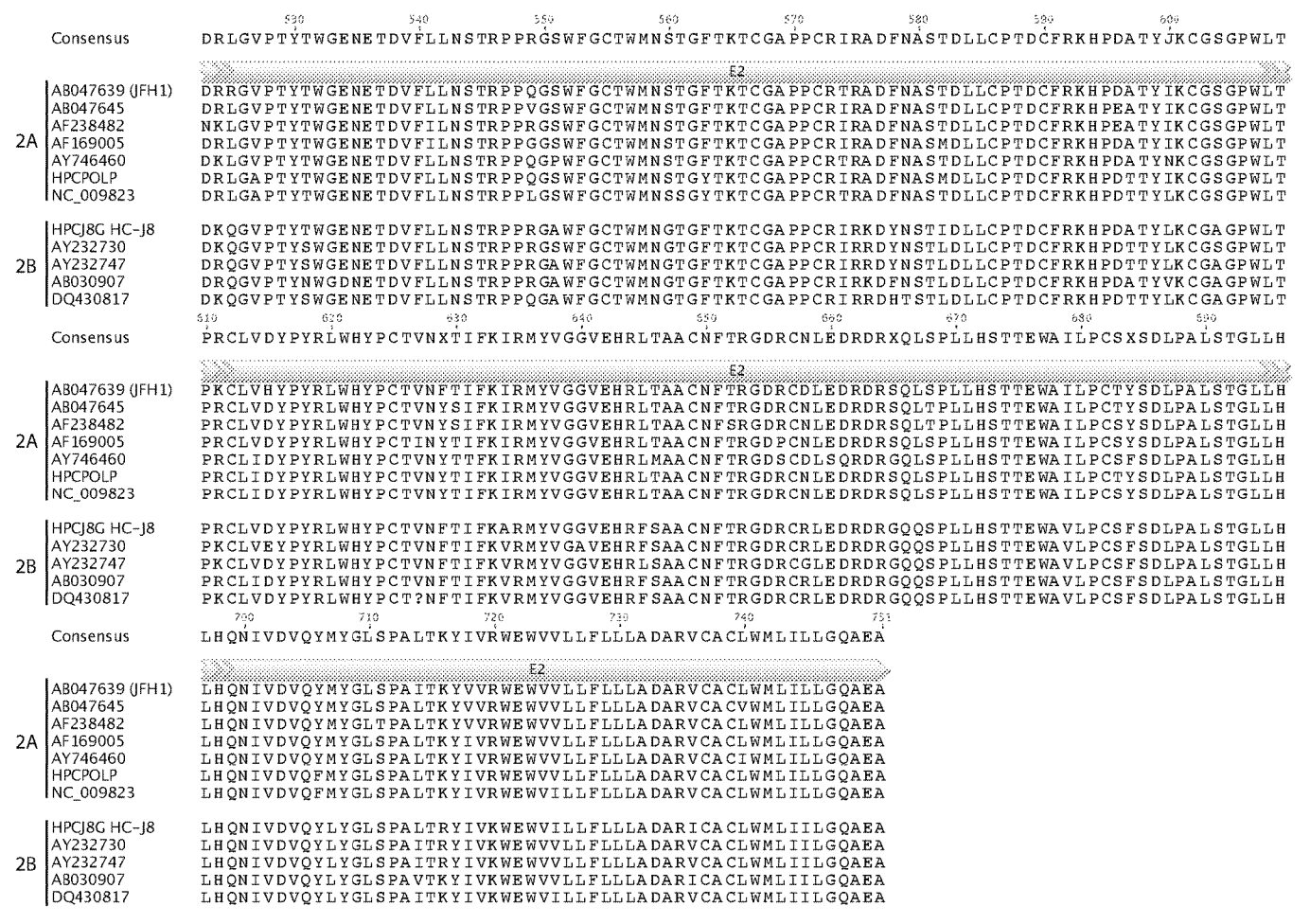

An E2 polypeptide suitable for inclusion in a variant E2 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIGS. 2A-2C. For example, an E2 polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-751 of an amino acid sequence depicted in FIGS. 2A-2C. For example, an E2 polypeptide of genotype 2A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-751 of the "consensus" amino acid sequence depicted in FIGS. 2A-2C. For example, an E2 polypeptide of genotype 2B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-751 of the "consensus" amino acid sequence depicted in FIGS. 2A-2C.

An E2 polypeptide suitable for inclusion in a variant E2 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIGS. 3A-3C. For example, an E2 polypeptide of genotype 3 can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of an amino acid sequence depicted in FIGS. 3A-3C. For example, an E2 polypeptide of genotype 3A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of an amino acid sequence identified as 3A and depicted in FIGS. 3A-3C. For example, an E2 polypeptide of genotype 3B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of the amino acid sequence identified as 3B and depicted in FIGS. 3A-3C. For example, an E2 polypeptide of genotype 3K can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of the amino acid sequence identified as 3K and depicted in FIGS. 3A-3C.

An E2 polypeptide suitable for inclusion in a variant E2 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the amino acid sequence of the E2 polypeptide depicted in FIGS. 4A-4B. For example, an E2 polypeptide of genotype 7A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-750 of the amino acid sequence depicted in FIGS. 4A-4B.

Heterologous Polypeptide

In some cases, the heterologous polypeptide comprises 1, 2, 3, 4, 5, 6, 7, 8, 9, or 10, or more than 10 (e.g., from 10 to 15, from 15 to 20, from 20 to 25, or from 25 to 30, or more than 30), T cell epitopes. T-cell epitopes are epitopes that, when presented with a major histocompatibility complex (MHC) (e.g., a human leukocyte antigen (HLA)) Class I or MHC Class II molecule, are recognized and bound by a T-cell receptor (TCR) present on a T cell surface. T-cell epitopes include epitopes recognized by cytotoxic T cells (e.g., $CD8^+$ T cells), and epitopes recognized by helper T cells (e.g., $CD4^+$ T cells).

The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein. A suitable source of T-cell epitopes non-toxic mutants of toxins, where the mutants are referred to as "cross-reactive material (CRM)." Other examples of strong T helper epitopes are diphtheria toxoid, tetanus toxoid, meningococcal outer membrane protein, or mutant diphtheria protein CRM197 (see, e.g.: www(dot) medscape(dot)com/viewarticle/431127).

In some cases, the heterologous polypeptide comprises a single T-cell epitope. In some cases, the heterologous polypeptide comprises a single HCV-NS3 T-cell epitope. In some cases, the heterologous polypeptide comprises 2 or more T-cell epitopes. In some cases, the heterologous polypeptide comprises 2 or more HCV-NS3 T-cell epitopes. In some cases, the heterologous polypeptide comprises 3 or more HCV-NS3 T-cell epitopes. In some cases, the heterologous polypeptide comprises 4 or more HCV-NS3 T-cell epitopes. In some cases, the heterologous polypeptide comprises a single HCV-NS3 $CD4^+$ T-cell epitope. In some cases, the heterologous polypeptide comprises 2 or more HCV-NS3 $CD4^+$ T-cell epitopes. In some cases, the heterologous polypeptide comprises one or more HCV $CD8^+$ T cell epitopes. In some cases, the heterologous polypeptide comprises a single HCV-NS3 $CD8^+$ T-cell epitope. In some cases, the heterologous polypeptide comprises 2 or more HCV-NS3 $CD8^+$ T-cell epitopes. In some cases, the heterologous polypeptide comprises at least one HCV $CD4^+$ T cell epitope and at least one HCV $CD8^+$ T cell epitope. In some cases, the heterologous polypeptide comprises at least one HCV-NS3 $CD4^+$ T cell epitope and at least one HCV-NS3 $CD8^+$ T cell epitope. In some cases, heterologous polypeptide comprises 2 or more HCV-NS3 $CD4^+$ T-cell epitopes and 2 or more HCV-NS3 $CD8^+$ T-cell epitopes. In some cases, the heterologous polypeptide comprises 2, 3, 4, or 5 HCV-NS3 $CD4^+$ T-cell epitopes and 2, 3, 4, or 5 HCV-NS3 $CD8^+$ T-cell epitopes.

In some cases, the heterologous polypeptide comprises a single T-cell epitope. In some cases, the heterologous polypeptide comprises a single HCV-NS2 T-cell epitope. In some cases, the heterologous polypeptide comprises 2 or more T-cell epitopes. In some cases, the heterologous polypeptide comprises 2 or more HCV-NS2 T-cell epitopes. In some cases, the heterologous polypeptide comprises 3 or more HCV-NS2 T-cell epitopes. In some cases, the heterologous polypeptide comprises 4 or more HCV-NS2 T-cell epitopes.

In some cases, the heterologous polypeptide comprises a single HCV-NS2 CD4$^+$ T-cell epitope. In some cases, the heterologous polypeptide comprises 2 or more HCV-NS2 CD4$^+$ T-cell epitopes. In some cases, the heterologous polypeptide comprises one or more HCV CD8$^+$ T cell epitopes. In some cases, the heterologous polypeptide comprises a single HCV-NS2 CD8$^+$ T-cell epitope. In some cases, the heterologous polypeptide comprises 2 or more HCV-NS2 CD8$^+$ T-cell epitopes. In some cases, the heterologous polypeptide comprises at least one HCV CD4$^+$ T cell epitope and at least one HCV CD8$^+$ T cell epitope. In some cases, the heterologous polypeptide comprises at least one HCV-NS2 CD4$^+$ T cell epitope and at least one HCV-NS2 CD8$^+$ T cell epitope. In some cases, heterologous polypeptide comprises 2 or more HCV-NS2 CD4$^+$ T-cell epitopes and 2 or more HCV-NS2 CD8$^+$ T-cell epitopes. In some cases, the heterologous polypeptide comprises 2, 3, 4, or 5 HCV-NS2 CD4$^+$ T-cell epitopes and 2, 3, 4, or 5 HCV-NS2 CD8$^+$ T-cell epitopes.

In some cases, the heterologous polypeptide comprises a single T-cell epitope. In some cases, the heterologous polypeptide comprises a single HCV-NS4A T-cell epitope. In some cases, the heterologous polypeptide comprises 2 or more T-cell epitopes. In some cases, the heterologous polypeptide comprises 2 or more HCV-NS4A T-cell epitopes. In some cases, the heterologous polypeptide comprises 3 or more HCV-NS4A T-cell epitopes. In some cases, the heterologous polypeptide comprises 4 or more HCV-NS4A T-cell epitopes. In some cases, the heterologous polypeptide comprises a single HCV-NS4A CD4$^+$ T-cell epitope. In some cases, the heterologous polypeptide comprises 2 or more HCV-NS4A CD4$^+$ T-cell epitopes. In some cases, the heterologous polypeptide comprises one or more HCV CD8$^+$ T cell epitopes. In some cases, the heterologous polypeptide comprises a single HCV-NS4A CD8$^+$ T-cell epitope. In some cases, the heterologous polypeptide comprises 2 or more HCV-NS4A CD8$^+$ T-cell epitopes. In some cases, the heterologous polypeptide comprises at least one HCV CD4$^+$ T cell epitope and at least one HCV CD8$^+$ T cell epitope. In some cases, the heterologous polypeptide comprises at least one HCV-NS4A CD4$^+$ T cell epitope and at least one HCV-NS4A CD8$^+$ T cell epitope. In some cases, heterologous polypeptide comprises 2 or more HCV-NS4A CD4$^+$ T-cell epitopes and 2 or more HCV-NS4A CD8$^+$ T-cell epitopes. In some cases, the heterologous polypeptide comprises 2, 3, 4, or 5 HCV-NS4A CD4$^+$ T-cell epitopes and 2, 3, 4, or 5 HCV-NS4A CD8$^+$ T-cell epitopes.

In some cases, the heterologous polypeptide comprises a single T-cell epitope. In some cases, the heterologous polypeptide comprises a single HCV-NS5A T-cell epitope. In some cases, the heterologous polypeptide comprises 2 or more T-cell epitopes. In some cases, the heterologous polypeptide comprises 2 or more HCV-NS5A T-cell epitopes. In some cases, the heterologous polypeptide comprises 3 or more HCV-NS5A T-cell epitopes. In some cases, the heterologous polypeptide comprises 4 or more HCV-NS5A T-cell epitopes. In some cases, the heterologous polypeptide comprises a single HCV-NS5A CD4$^+$ T-cell epitope. In some cases, the heterologous polypeptide comprises 2 or more HCV-NS5A CD4$^+$ T-cell epitopes. In some cases, the heterologous polypeptide comprises one or more HCV CD8$^+$ T cell epitopes. In some cases, the heterologous polypeptide comprises a single HCV-NS5A CD8$^+$ T-cell epitope. In some cases, the heterologous polypeptide comprises 2 or more HCV-NS5A CD8$^+$ T-cell epitopes. In some cases, the heterologous polypeptide comprises at least one HCV CD4$^+$ T cell epitope and at least one HCV CD8$^+$ T cell epitope. In some cases, the heterologous polypeptide comprises at least one HCV-NS5A CD4$^+$ T cell epitope and at least one HCV-NS5A CD8$^+$ T cell epitope. In some cases, heterologous polypeptide comprises 2 or more HCV-NS5A CD4$^+$ T-cell epitopes and 2 or more HCV-NS5A CD8$^+$ T-cell epitopes. In some cases, the heterologous polypeptide comprises 2, 3, 4, or 5 HCV-NS5A CD4$^+$ T-cell epitopes and 2, 3, 4, or 5 HCV-NS5A CD8$^+$ T-cell epitopes.

In some cases, the heterologous polypeptide comprises a single T-cell epitope. In some cases, the heterologous polypeptide comprises a single HCV-NS5B T-cell epitope. In some cases, the heterologous polypeptide comprises 2 or more T-cell epitopes. In some cases, the heterologous polypeptide comprises 2 or more HCV-NS5B T-cell epitopes. In some cases, the heterologous polypeptide comprises 3 or more HCV-NS5B T-cell epitopes. In some cases, the heterologous polypeptide comprises 4 or more HCV-NS5B T-cell epitopes. In some cases, the heterologous polypeptide comprises a single HCV-NS5B CD4$^+$ T-cell epitope. In some cases, the heterologous polypeptide comprises 2 or more HCV-NS5B CD4$^+$ T-cell epitopes. In some cases, the heterologous polypeptide comprises one or more HCV CD8$^+$ T cell epitopes. In some cases, the heterologous polypeptide comprises a single HCV-NS5B CD8$^+$ T-cell epitope. In some cases, the heterologous polypeptide comprises 2 or more HCV-NS5B CD8$^+$ T-cell epitopes. In some cases, the heterologous polypeptide comprises at least one HCV CD4$^+$ T cell epitope and at least one HCV CD8$^+$ T cell epitope. In some cases, the heterologous polypeptide comprises at least one HCV-NS5B CD4$^+$ T cell epitope and at least one HCV-NS5B CD8$^+$ T cell epitope. In some cases, heterologous polypeptide comprises 2 or more HCV-NS5B CD4$^+$ T-cell epitopes and 2 or more HCV-NS5B CD8$^+$ T-cell epitopes. In some cases, the heterologous polypeptide comprises 2, 3, 4, or 5 HCV-NS5B CD4$^+$ T-cell epitopes and 2, 3, 4, or 5 HCV-NS5B CD8$^+$ T-cell epitopes.

In some cases, the heterologous polypeptide comprises a single T-cell epitope. In some cases, the heterologous polypeptide comprises a single HCV-core T-cell epitope. In some cases, the heterologous polypeptide comprises 2 or more T-cell epitopes. In some cases, the heterologous polypeptide comprises 2 or more HCV-core T-cell epitopes. In some cases, the heterologous polypeptide comprises 3 or more HCV-core T-cell epitopes. In some cases, the heterologous polypeptide comprises 4 or more HCV-core T-cell epitopes. In some cases, the heterologous polypeptide comprises a single HCV-core CD4$^+$ T-cell epitope. In some cases, the heterologous polypeptide comprises 2 or more HCV-core CD4$^+$ T-cell epitopes. In some cases, the heterologous polypeptide comprises one or more HCV CD8$^+$ T cell epitopes. In some cases, the heterologous polypeptide comprises a single HCV-core CD8$^+$ T-cell epitope. In some cases, the heterologous polypeptide comprises 2 or more HCV-core CD8$^+$ T-cell epitopes. In some cases, the heterologous polypeptide comprises at least one HCV CD4$^+$ T cell epitope and at least one HCV CD8$^+$ T cell epitope. In some cases, the heterologous polypeptide comprises at least one HCV-core CD4$^+$ T cell epitope and at least one HCV-core CD8$^+$ T cell epitope. In some cases, heterologous polypeptide comprises 2 or more HCV-core CD4$^+$ T-cell epitopes and 2 or more HCV-core CD8$^+$ T-cell epitopes. In some cases, the heterologous polypeptide comprises 2, 3, 4, or 5 HCV-core CD4$^+$ T-cell epitopes and 2, 3, 4, or 5 HCV-core CD8$^+$ T-cell epitopes.

In some cases, the heterologous polypeptide comprises a single T-cell epitope. In some cases, the heterologous polypeptide comprises a single HCV-p7 T-cell epitope. In some cases, the heterologous polypeptide comprises 2 or more T-cell epitopes. In some cases, the heterologous polypeptide comprises 2 or more HCV-p7 T-cell epitopes. In some cases, the heterologous polypeptide comprises 3 or more HCV-p7 T-cell epitopes. In some cases, the heterologous polypeptide comprises 4 or more HCV-p7 T-cell epitopes. In some cases, the heterologous polypeptide comprises a single HCV-p7 CD4$^+$ T-cell epitope. In some cases, the heterologous polypeptide comprises 2 or more HCV-core CD4$^+$ T-cell epitopes. In some cases, the heterologous polypeptide comprises one or more HCV CD8$^+$ T cell epitopes. In some cases, the heterologous polypeptide comprises a single HCV-p7 CD8$^+$ T-cell epitope. In some cases, the heterologous polypeptide comprises 2 or more HCV-p7 CD8$^+$ T-cell epitopes. In some cases, the heterologous polypeptide comprises at least one HCV CD4$^+$ T cell epitope and at least one HCV CD8$^+$ T cell epitope. In some cases, the heterologous polypeptide comprises at least one HCV-p7 CD4$^+$ T cell epitope and at least one HCV-p7 CD8$^+$ T cell epitope. In some cases, heterologous polypeptide comprises 2 or more HCV-p7 CD4$^+$ T-cell epitopes and 2 or more HCV-p7 CD8$^+$ T-cell epitopes. In some cases, the heterologous polypeptide comprises 2, 3, 4, or 5 HCV-p7 CD4$^+$ T-cell epitopes and 2, 3, 4, or 5 HCV-p7 CD8$^+$ T-cell epitopes.

In some cases, the heterologous polypeptide comprises 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, or 63, of the T-cell epitopes set out in FIGS. 13A-13B. In some cases, the heterologous polypeptide comprises from 1 to 3, from 3 to 5, from 5 to 10, from 10 to 15, from 15 to 20, from 20 to 25, or from 25 to 30 of the T-cell epitopes set out in FIGS. 13A-13B. For example, in some cases, the heterologous polypeptide comprises the T-cell epitopes designated NS3-3, NS3-4, and NS3-11 in FIGS. 13A-13B and FIGS. 15A-15N. As another example, in some cases, the heterologous polypeptide comprises the T-cell epitopes designated NS2-1, NS2-2, NS2-3, NS2-7, and NS2-8 in FIGS. 13A-13B and FIGS. 15A-15N. As another example, in some cases, the heterologous polypeptide comprises the T-cell epitopes designated NS3-3, NS3-4, NS3-5, and NS3-11 in FIGS. 13A-13B and FIGS. 15A-15N. As another example, in some cases, the heterologous polypeptide comprises the T-cell epitopes designated NS3-3, NS3-4, NS3-5, NS3-6, NS3-7, NS3-11, NS3-12, and NS3-13 in FIGS. 13A-13B and FIGS. 15A-15N. As another example, in some cases, the heterologous polypeptide comprises the T-cell epitopes designated NS3-3, NS3-4, NS3-5, NS3-6, NS3-7, NS3-10, NS3-11, NS3-12, and NS3-13 in FIGS. 13A-13B and FIGS. 15A-15N. As another example, in some cases, the heterologous polypeptide comprises the T-cell epitopes designated Core-1, Core-2, Core-3, Core-4, Core-5, Core-6, Core-7, Core-8, Core-9, Core-10, Core-11, Core-12, Core-13, Core-14, Core-16, Core-17, Core-18, Core-19, Core-20, Core-21, and Core-22 in FIGS. 13A-13B and FIGS. 15A-15N. As another example, in some cases, the heterologous polypeptide comprises the T-cell epitopes designated NS3-1, NS3-2, NS3-3, NS3-4, NS3-5, NS3-6, NS3-7, NS3-9, NS3-10, NS3-11, NS3-12, and NS3-13 in FIGS. 13A-13B and FIGS. 15A-15N. As another example, in some cases, the heterologous polypeptide comprises the T-cell epitopes designated NS2-1, NS2-2, NS2-3, NS2-4, NS2-5, NS2-6, NS2-7, NS2-8, NS3-1, NS3-2, NS3-3, NS3-4, NS3-5, NS3-6, NS3-7, NS3-9, NS3-10, NS3-11, NS3-12, and NS3-13 in FIGS. 13A-13B and FIGS. 15A-15N. As another example, in some cases, the heterologous polypeptide comprises the T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, and NS4b-10 in FIGS. 13A-13B and FIGS. 15A-15N. As another example, in some cases, the heterologous polypeptide comprises the T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10, NS5a-1, NS5a-2, NS5b-1, and NS5b-2 in FIGS. 13A-13B and FIGS. 15A-15N. In some cases, the T-cell epitopes are contiguous. In some cases, any two T-cell epitopes are separated by linkers (e.g., a linker having a length of from 1 amino acid to about 50 amino acids, e.g., from 1 amino acid to 5 amino acids (aa), from 5 aa to 10 aa, from 10 aa to 15 aa, from 15 aa to 20 aa, from 20 aa to 25 aa, from 25 aa to 30 aa, from 30 aa to 40 aa, or from 40 aa to 50 aa).

In some cases, the heterologous polypeptide comprises at least one HCV CD4$^+$ T cell epitope and at least one HCV CD8$^+$ T cell epitope, where epitopes are conserved among HCV genotypes 1 and 2. In some cases, the heterologous polypeptide comprises at least one HCV CD4$^+$ T cell epitope and at least one HCV CD8$^+$ T cell epitope, where epitopes are conserved among HCV genotypes 1 and 3. In some cases, the heterologous polypeptide comprises at least one HCV CD4$^+$ T cell epitope and at least one HCV CD8$^+$ T cell epitope, where epitopes are conserved among HCV genotypes 1, 2, and 3. In some cases, the heterologous polypeptide comprises at least one HCV CD4$^+$ T cell epitope and at least one HCV CD8$^+$ T cell epitope, where epitopes are conserved among HCV genotypes 1, 2, 3, and 7. In some cases, the heterologous polypeptide comprises at least one HCV CD4$^+$ T cell epitope and at least one HCV CD8$^+$ T cell epitope, where epitopes are conserved among HCV genotypes 1-7.

The heterologous polypeptide can have a length of from about 10 amino acids to about 2000 amino acids; e.g., the heterologous polypeptide can have a length of from 10 amino acids (aa) to 15 aa, from 15 aa to 20 aa, from 20 aa to 25 aa, from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The heterologous polypeptide can have a length of from about 25 amino acids to about 2000 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 500 aa, from 500 aa to 600 aa, from 600 aa to 700 aa, from 700 aa to 800 aa, from 800 aa to 900 aa, from 900 aa to 1000 aa, from 1000 aa to 1100 aa, from 1100 aa to 1200 aa, from 1200 aa to 1300 aa, from 1300 aa to 1400 aa, from 1400 aa to 1500 aa, from 1500 aa to 1600 aa, from 1600 aa to 1700 aa, from 1700 aa to 1800 aa, from 1800 aa to 1900 aa, or from 1900 aa to 2000 aa. The heterologous polypeptide can have a length of from about 25 amino acids to about 3000 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 500 aa, from 500 aa to 600 aa, from 600 aa to 700 aa, from 700 aa to 800 aa, from 800 aa to 900 aa, from 900 aa to 1000 aa, from 1000 aa to 1100 aa, from 1100 aa to 1200 aa, from 1200 aa to 1300 aa, from 1300 aa to 1400 aa, from 1400 aa to 1500 aa, from 1500 aa to 1600 aa, from 1600 aa to 1700 aa, from 1700 aa to 1800 aa, from 1800 aa to 1900 aa, from 1900 aa to 2000 aa, from 2000 aa to 2250 aa, from 2250 aa to 2500 aa, from 2500 aa to 2750 aa, or from 2750 aa to 3000 aa.

The heterologous polypeptide can have a length of from about 25 amino acids to about 800 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The heterologous polypeptide can have a length of from about 25 amino acids to about 400 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, or from 350 aa to 400 aa. The heterologous polypeptide can have a length of 25 amino acids (aa), 26 aa, 27 aa, 28 aa, 29 aa, 30 aa, 31 aa, 32 aa, 33 aa, 34 aa, 35 aa, 36 aa, 37 aa, 38 aa, 39 aa, 40 aa, 41 aa, 42 aa, 43 aa, 44 aa, 45 aa, 46 aa, 47 aa, 48 aa, 49 aa, or 50 aa. The heterologous polypeptide can have a length of from about 100 amino acids (aa) to 800 aa, e.g., from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The heterologous polypeptide can have a length of from 25 aa to 30 aa. The heterologous polypeptide can have a length of from 30 aa to 40 aa. The heterologous polypeptide can have a length of from 40 aa to 50 aa. The heterologous polypeptide can have a length of from 50 aa to 60 aa (e.g., 50 aa, 51 aa, 52, aa, 53 aa, 54 aa, 55 aa, 56 aa, 57 aa, 58 aa, 59 aa, or 60 aa). The heterologous polypeptide can have a length of from 60 aa to 70 aa. The heterologous polypeptide can have a length of from 65 aa to 75 aa (e.g., 65, 66, 67, 68, 69, 70, 71, 72, 7, 74, or 75 aa). The heterologous polypeptide can have a length of 70 aa. The heterologous polypeptide can have a length of from 70 aa to 80 aa. The heterologous polypeptide can have a length of from 80 aa to 90 aa. The heterologous polypeptide can have a length of from 90 aa to 100 aa. The heterologous polypeptide can have a length of from 100 aa to 105 aa (e.g., 100, 101, 102, 103, 104, 105, 106, 107, 108, 109, or 110 aa). The heterologous polypeptide can have a length of 100 aa. The heterologous polypeptide can have a length of from 10 amino acids (aa) to 50 aa; e.g., from 10 aa to 15 aa, from 15 aa to 20 aa, from 20 aa to 25 aa, from 25 aa to 30 aa, from 30 aa to 35 aa, from 35 aa to 40 aa, from 40 aa to 45 aa, or from 45 aa to 50 aa. The heterologous polypeptide can have a length of from 10 amino acids (aa) to 20 aa, e.g., 10, 11, 12, 13, 14, 15, 16, 17, 18, 19, or 20 aa.

HCV NS3 T-Cell Epitopes

In some cases, the heterologous polypeptide present in an E2 variant polypeptide of an E1/E2 heterodimer of the present disclosure includes one or more T-cell epitopes present in an HCV NS3 polypeptide. Examples of T-cell epitopes present in NS3 polypeptides are depicted in FIGS. 15A-15N, FIG. 13B, and FIGS. 14A-14B.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKL (SEQ ID NO: 1). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKL (SEQ ID NO: 1); and has a length of from 25 aa to 35 aa (e.g., 25 aa, 26 aa, 27 aa, 28 aa, 29 aa, 30 aa, 31 aa, 32 aa, 33 aa, 34 aa, or 35 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKG-GRHLIFCHSKKKCDELAAKL (SEQ ID NO: 1); and has a length of 29 amino acids. Such a polytope can include NS3 T-cell epitopes designated NS3-3, NS3-4, and NS3-11 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKLVALGI-NAVAYYRGLDVSVIPTSG (SEQ ID NO:2). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKLVALGI-NAVAYYRGLDVSVIPTSG (SEQ ID NO:2); and has a length of from 45 amino acids to 60 amino acids (e.g., 45 aa, 46 aa, 47 aa, 48 aa, 49 aa, 50 aa, 51 aa, 52 aa, 53 aa, 54 aa, 55 aa, 56 aa, 57 aa, 58 aa, 59 aa, or 60 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKLVALGI-NAVAYYRGLDVSVIPTSG (SEQ ID NO:2); and has a length of 52 amino acids. Such a polytope can include NS3 T-cell epitopes designated NS3-3, NS3-4, NS3-5, and NS3-11 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: KGGRHLIFCHSKKKCDELAAKLVALGINAVAYYR-GLDVSVIPTSGDVVVVATDALMTG FTGDFDSVIDCN (SEQ ID NO:3); and has a length of from 65 amino acids to 80 amino acids (e.g., 65 aa, 66 aa, 67 aa, 68 aa, 69 aa, 70 aa, 71 aa, 72 aa, 73 aa, 74 aa, 75 aa, 76 aa, 77 aa, 78 aa, 79 aa, or 80 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: KGGRHLIFCHSKKKCDE-LAAKLVALGINAVAYYRGLDVSVIPTSGDVVVVAT-DALMTG FTGDFDSVIDCN (SEQ ID NO:3); and has a length of 70 amino acids. Such a polytope can include NS3 T-cell epitopes designated NS3-3, NS3-4, NS3-5, NS3-6, NS3-7, NS3-11, NS3-12, and NS3-13 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: VALSTTGEIPFYGKAIPLEVIKGGRHLIFCHSKK-KCDELAAKLVALGINAVAYYRGLDVS VIPTSGDV-VVVATDALMTGFTGDFDSVIDCNTCVTQTVDF (SEQ ID NO:4); and has a length of from 95 amino acids (aa) to 105 aa (e.g., 95 aa, 96 aa, 97 aa, 98 aa, 99 aa, 100 aa, 101 aa, 102 aa, 103 aa, 104 aa, or 105 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: VALSTT-GEIPFYGKAIPLEVIKGGRHLIFCHSKKKCDELAAK-LVALGINAVAYYRGLDVS VIPTSGDVVVVATDALMT-GFTGDFDSVIDCNTCVTQTVDF (SEQ ID NO:4); and has a length of 100 amino acids. Such a polytope can include NS3 T-cell epitopes designated NS3-3, NS3-4, NS3-5, NS3-6, NS3-7, NS3-10, NS3-11, NS3-12, and NS3-13 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQIVG-GVYLLPRRGPRLGVRATRKTSERSQP RGRRQPIP-KARRPEGRTWAQPGYPWPLYGNEGCGWAGWLL-SPRGSRPSWGPTDPRRRS RNLGKVIDTLTCGFADLMGYIPLVGAPLGGAARAL-AHGVRVLEDGVNYATGNLPGCSF SIFLLALLSCLTV-PASA (SEQ ID NO:9); and has a length of from 190 amino acids (aa) to 200 aa (e.g., 190 aa, 191 aa, 192 aa, 193 aa, 194 aa, 195 aa, 196 aa, 197 aa, 198 aa, 199 aa, or 200 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQIVG-GVYLLPRRGPRLGVRATRKTSERSQP RGRRQPIP-KARRPEGRTWAQPGYPWPLYGNEGCGWAGWLL-SPRGSRPSWGPTDPRRRS RNLGKVIDTLTCGFADLMGYIPLVGAPLGGAARAL-AHGVRVLEDGVNYATGNLPGCSF SIFLLALLSCLTV-PASA (SEQ ID NO:9); and has a length of 191 amino acids.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGKSTKVPAAYAAQGYKVLVLNPSVAATLG-FGAYMSKAHGIDPNIRTGVRTIT TGSPITYSTYGK-FLADGGCSGGAYDIIICDECHSTDATSILGIGTV-LDQAETAGARLVVLA TATPPGSVTVPHPNIEEVALSTTGEIPFYGKAIPLEVIK-GGRHLIFCHSKKKCDELAAKLV ALGINAVAYYRGLD-VSVIPTSGDVVVVATDALMTGFTGDFDSVIDCN (SEQ ID NO: 10); and has a length of from 215 amino acids (aa) to 235 aa (e.g., 215 aa, 216 aa, 217 11, 218 aa, 219 aa, 220 aa, 221 aa, 222 aa, 223 aa, 224 aa, 225 aa, 226 aa, 227 aa, 228 aa, 229 aa, 230 aa, 231 aa, 232 aa, 233 aa, 234 aa, or 235 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGKSTKVPAAYAAQGYKVLVL-NPSVAATLGFGAYMSKAHGIDPNIRTGVRTIT TGSPI-TYSTYGKFLADGGCSGGAYDIIICDECHSTDATSIL-GIGTVLDQAETAGARLVVLA TATPPGSVTVPHPNIEEVALSTTGEIPFYGKAIPLEVIK-GGRHLIFCHSKKKCDELAAKLV ALGINAVAYYRGLD-VSVIPTSGDVVVVATDALMTGFTGDFDSVIDCN (SEQ ID NO: 10); and has a length of 228 amino acids. Such a polytope can include NS3 T-cell epitopes designated NS3-1, NS3-2, NS3-3, NS3-4, NS3-5, NS3-6, NS3-7, NS3-9, NS3-10, NS3-11, NS3-12, and NS3-13 in FIG. 13B and FIGS. 15A-15N.

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1265-1279 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1309-1323 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1401-1415 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1402-1412 of the amino acid sequence designated "Consensus" in FIGS. 16A-16L, or a corresponding HCV NS3 amino acid sequence of any HCV genotype; and the HCV NS3 T-cell epitope can have a length of from 11 amino acids (aa) to 16 amino acids (e.g., 11 aa, 12 aa, 13 aa, 14 aa, 15 aa, or 16 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1429-1439 of the amino acid sequence designated "Consensus" in FIGS. 16A-16L, or a corresponding HCV NS3 amino acid sequence of any HCV genotype; and the HCV NS3 T-cell epitope can have a length of from 11 amino acids (aa) to 16 amino acids (e.g., 11 aa, 12 aa, 13 aa, 14 aa, 15 aa, or 16 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1450-1464 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1453-1467 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1577-1591 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1306-1314 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1387-1394 of the amino acid sequence designated "Consensus" in FIGS. 16A-16L, or a corresponding HCV NS3 amino acid sequence of any HCV genotype; and the HCV NS3 T-cell epitope can have a length of from 1 amino acids (aa) to 15 amino acids (e.g., 8 aa, 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1405-1413 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1450-1458 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1457-1465 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1610-1618 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

HCV NS2 T-Cell Epitopes

In some cases, the heterologous polypeptide present in an E2 variant polypeptide of an E1/E2 heterodimer of the present disclosure includes one or more T-cell epitopes present in an HCV NS2 polypeptide. Examples of T-cell epitopes present in NS2 polypeptides are depicted in FIGS. 15A-15N, and FIG. 13A.

For example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 955-974 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 975-994 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 985-1004 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1015-1034 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1035-1054 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 924-933 of the amino acid sequence designated "Consensus" in FIGS. 16A-16L, or a corresponding HCV NS2 amino acid sequence of any HCV genotype; and the NS2 T cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 961-970 of the amino acid sequence designated "Consensus" in FIGS. 16A-16L, or a corresponding HCV NS2 amino acid sequence of any HCV genotype; and the NS2 T cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 989-997 of the amino acid sequence designated "Consensus" in FIGS. 16A-16L, or a corresponding HCV NS2 amino acid sequence of any HCV genotype; and the NS2 T cell epitope can have a length of from 9 amino acids (aa) to 15 amino acids (e.g., 9 aa, 10 aa, 11 aa, 12 aa, 13 aa, 14 aa, or 15 aa).

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 50 aa (e.g., from 10 aa to 25 aa, or from 25 aa to 50 aa) of amino acids 955-1004 of the amino acid sequence designated "Consensus" in FIGS. 16A-16L, or a corresponding HCV NS2 amino acid sequence of any HCV genotype; and has a length of from 10 amino acids (aa) to 25 aa, or from 25 aa to 50 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 955-1004 of the amino acid sequence designated "Consensus" in FIGS. 16A-16L, or a corresponding HCV NS2 amino acid sequence of any HCV genotype; and has a length of about 50 amino acids.

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 553 aa (e.g., from 10 aa to 25 aa, from 25 aa to 50 aa, from 50 aa to 100 aa, from 100 aa to 200 aa, from 200 aa to 300 aa, from 300 aa to 400 aa, from 400 aa to 500 aa, or from 500 aa to 553 aa) of amino acids 917-1469 of the amino acid sequence designated "Consensus" in FIGS. 16A-16L, or a corresponding HCV NS2 and NS3 amino acid sequence of any HCV genotype; and has a length of from 10 amino acids (aa) to 25 aa, from 25 aa to 50 aa, from 50 aa to 100 aa, from 100 aa to 200 aa, from 200 aa to 300 aa, from 300 aa to 400 aa, from 400 aa to 500 aa, or from 500 aa to 553 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 917-1469 of the amino acid sequence designated "Consensus" in FIGS. 16A-16L, or a corresponding HCV NS2 and NS3 amino acid sequence of any HCV genotype; and has a length of about 553 amino acids.

The heterologous polypeptide can comprise an amino acid sequence having at least about 20%, at least about 25%, at least about 30%, at least about 35%, at least about 40%, at least about 45%, at least about 50%, at least about 60%, at least about 0%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRDWAHNGLRDLAVAVEPV-VFSQMETKLITWGADT (SEQ ID NO: 11). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRDWAHNGLRDLAVAVEPV-VFSQMETKLITWGADT (SEQ ID NO:11); and has a length of from 50 amino acids to 60 amino acids (e.g., 50 aa, 51 aa, 52 aa, 53 aa, 54 aa, 55 aa, 56 aa, 57 aa, 58 aa, 59 aa, or 60 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRD-WAHNGLRDLAVAVEPVVFSQMETKLITWGADT (SEQ ID NO: 11); and has a length of 50 amino acids. Such a polytope can include NS2 T-cell epitopes designated NS2-1, NS2-2, NS2-3, NS2-7, and NS2-8 in FIG. 13A and FIGS. 15A-15N.

HCV NS4A T-Cell Epitopes

In some cases, the heterologous polypeptide present in an E2 variant polypeptide of an E1/E2 heterodimer of the present disclosure includes one or more T-cell epitopes present in an HCV NS4A polypeptide. Examples of T-cell epitopes present in NS4A polypeptides are depicted in FIGS. 15A-15N and FIG. 13B.

The heterologous polypeptide can comprise an NS4A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1683-1692 of the amino acid sequence designated "Consensus" in FIGS. 16A-16L, or a corresponding HCV NS4A amino acid sequence of any HCV genotype; and the NS4A T-cell epitope can have a length of from 10 amino acids (aa) to 15 amino acids (e.g., 10 aa, 11 aa, 12 aa, 13 aa, 14 aa, or 15 aa).

HCV NS4B T-Cell Epitopes

In some cases, the heterologous polypeptide present in an E2 variant polypeptide of an E1/E2 heterodimer of the present disclosure includes one or more T-cell epitopes present in an HCV NS4B polypeptide. Examples of T-cell epitopes present in NS4B polypeptides are depicted in FIGS. 15A-15N and FIG. 13B.

As one example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1790-1801 of the amino acid sequence designated "Consensus" in FIGS. 16A-16L, or a corresponding HCV NS4B amino acid sequence of any HCV genotype; and the NS4B T-cell epitope can have a length of from 12 amino acids (aa) to 20 amino acids (e.g., 12 aa, 13 aa, 14 aa, 15 aa, 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1792-1802 of the amino acid sequence designated "Consensus" in FIGS. 16A-16L, or a corresponding HCV NS4B amino acid sequence of any HCV genotype; and the NS4B T-cell epitope can have a length of from 11 amino acids (aa) to 20 amino acids (e.g., 11 aa, 12 aa, 13 aa, 14 aa, 15 aa, 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1898-1905 of the amino acid sequence designated "Consensus" in FIGS. 16A-16L, or a corresponding HCV NS4B amino acid sequence of any HCV genotype; and the NS4B T-cell epitope can have a length of from 8 amino acids (aa) to 15 amino acids (e.g., 8 aa, 9 aa, 10 aa, 11 aa, 12 aa, 13 aa, 14 aa, or 15 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1921-1935 of the amino acid sequence designated "Consensus" in FIGS. 16A-16L, or a corresponding HCV NS4B amino acid sequence of any HCV genotype; and the NS4B T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1922-1941 of the amino acid sequence designated "Consensus" in FIGS. 16A-16L, or a corresponding HCV NS4B amino acid sequence of any HCV genotype; and the NS4B T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1928-1947 of the amino acid sequence designated "Consensus" in FIGS. 16A-16L, or a corresponding HCV NS4B amino acid sequence of any HCV genotype; and the NS4B T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1868-1876 of the amino acid sequence designated "Consensus" in FIGS. 16A-16L, or a corresponding HCV NS4B amino acid sequence of any HCV genotype; and the NS4B T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1927-1942 of the amino acid sequence designated "Consensus" in FIGS. 16A-16L, or a corresponding HCV NS4B amino acid sequence of any HCV genotype; and the NS4B T-cell epitope can have a length of from 16 amino acids (aa) to 20 amino acids (e.g., 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1932-1940 of the amino acid sequence designated "Consensus" in FIGS. 16A-16L, or a corresponding HCV NS4B amino acid sequence of any HCV genotype; and the NS4B T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1948-1962 of the amino acid sequence designated "Consensus" in FIGS. 16A-16L, or a corresponding HCV NS4B amino acid sequence of any HCV genotype; and the NS4B T-cell epitope can have a length of from 15 amino acids (aa) to 20 amino acids (e.g., 15 aa, 16 aa, 17 aa, 18 aa, 19 aa, or 20 aa).

HCV NS5A T-Cell Epitopes

In some cases, the heterologous polypeptide present in an E2 variant polypeptide of an E1/E2 heterodimer of the present disclosure includes one or more T-cell epitopes present in an HCV NS5A polypeptide. Examples of T-cell epitopes present in NS5A polypeptides are depicted in FIGS. 15A-15N and FIG. 13B.

As one example, the heterologous polypeptide can comprise an NS5A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2218-2232 of the amino acid sequence designated "Consensus" in FIGS. 16A-16L, or a corresponding HCV NS5A amino acid sequence of any HCV genotype; and the NS5A T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an NS5A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2309-2317 of the amino acid sequence designated "Consensus" in FIGS. 16A-16L, or a corresponding HCV NS5A amino acid sequence of any HCV genotype; and the NS5A T-cell epitope can have a length of from 9 amino acids (aa) to 15 amino acids (e.g., 9 aa, 10 aa, 11 aa, 12 aa, 13 aa, 14 aa, or 15 aa).

HCV NS5B T-Cell Epitopes

In some cases, the heterologous polypeptide present in an E2 variant polypeptide of an E1/E2 heterodimer of the present disclosure includes one or more T-cell epitopes present in an HCV NS5B polypeptide. Examples of T-cell epitopes present in NS5B polypeptides are depicted in FIGS. 15A-15N and FIG. 13B.

As one example, the heterologous polypeptide can comprise an NS5B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2847-2851 of the amino acid sequence designated "Consensus" in FIGS. 16A-16L, or a corresponding HCV NS5B amino acid sequence of any HCV genotype; and the NS5B T-cell epitope can have a length of from 5 amino acids (aa) to 10 amino acids (e.g., 5 aa, 6 aa, 7 aa, 8 aa, 9 aa, or 10 aa).

As another example, the heterologous polypeptide can comprise an NS5B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2602-2610 of the amino acid sequence designated "Consensus" in FIGS. 16A-16L, or a corresponding HCV NS5B amino acid sequence of any HCV genotype; and the NS5B T-cell epitope can have a length of from 9 amino acids (aa) to 15 amino acids (e.g., 9 aa, 10 aa, 11 aa, 12 aa, 13 aa, 14 aa, or 15 aa).

HCV Core T-Cell Epitopes

In some cases, the heterologous polypeptide present in an E2 variant polypeptide of an E1/E2 heterodimer of the present disclosure includes one or more T-cell epitopes present in an HCV core polypeptide. Examples of T-cell epitopes present in HCV Core polypeptides are depicted in FIGS. 15A-15N and FIG. 13A.

As one example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1-20 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 11-30 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 21-40 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 39-63 of the amino acid sequence designated "Consensus" in FIGS. 16A-16L, or a corresponding HCV core amino acid sequence of any HCV genotype; and the HCV core T-cell epitope can have a length of from 23 amino acids (aa) to 28 amino acids (e.g., 23 aa, 24 aa, 25 aa, 26 aa, 27 aa, or 28 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 47-70 of the amino acid sequence designated "Consensus" in FIGS. 16A-16L, or a corresponding HCV core amino acid sequence of any HCV genotype; and the HCV core T-cell epitope can have a length of from 24 amino acids (aa) to 29 amino acids (e.g., 24 aa, 25 aa, 26 aa, 27 aa, 28 aa, or 29 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 61-80 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 71-90 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 81-100 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 91-110 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 101-115 of the amino acid sequence designated "Consensus" in FIGS. 16A-16L, or a corresponding HCV core amino acid sequence of any HCV genotype; and the HCV core T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 111-130 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 125-139 of the amino acid sequence designated "Consensus" in FIGS. 16A-16L, or a corresponding HCV core amino acid sequence of any HCV genotype; and the HCV core T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 131-150 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 151-170 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 161-180 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 35-44 of the amino acid sequence designated "Consensus" in FIGS. 16A-16L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 43-51 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 51-59 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 129-137 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 131-140 of the amino acid sequence designated "Consensus" in FIGS. 16A-16L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 150-158 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 154-162 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 168-176 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 177-187 of the amino acid sequence designated "Consensus" in FIGS. 16A-16L, or a corresponding HCV core amino acid sequence of any HCV genotype; and the HCV core T-cell epitope can have a length of from 11 amino acids (aa) to 16 amino acids (e.g., 11 aa, 12 aa, 13 aa, 14 aa, 15 aa, or 16 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 178-187 of the amino acid sequence designated "Consensus" in FIGS. 16A-16L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 191 aa (e.g., from 10 aa to 25 aa, from 25 aa to 50 aa, from 50 aa to 75 aa, from 75 aa to 100 aa, from 100 aa to 150 aa, or from 150 aa to 191 aa) of amino acids 1-191 of the amino acid sequence designated "Consensus" in FIGS. 16A-16L, or a corresponding HCV core amino acid sequence of any HCV genotype; and has a length of from 10 amino acids (aa) to 25 aa, from 25 aa to 50 aa, from 50 aa to 100 aa, or from 100 aa to 150 aa, or from 150 aa to 191 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1-191 of the amino acid sequence designated "Consensus" in FIGS. 16A-16L, or a corresponding HCV core amino acid sequence of any HCV genotype; and has a length of about 191 amino acids.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQIVG-GVYLLPRRGPRLGVRATRKTS ERSQPRGRRQPIP-KARRPEGRTWAQPGYPWPLYGNEGCGWAGWLL-SPRGSRPS WGPTDPRRRSRNLGKVIDTLTCGFADLMGYIPLVGA-PLGGAARALAHGVRVLE DGVNYATGNLPG (SEQ ID NO:63); and has a length of from 171 amino acids (aa) to 180 aa (e.g., 171 aa, 172 aa, 173 aa, 174 aa, 175 aa, 176 aa, 177 aa, 178 aa, 179 aa, or 180 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPK-PQRKTKRNTNRRPQDVKFPGGGQIVGGVYLLPRRG-PRLGVRATRKTS ERSQPRGRRQPIPKARRPEGRT-WAQPGYPWPLYGNEGCGWAGWLLSPRGSRPS WGPTDPRRRSRNLGKVIDTLTCGFADLMGYIPLVGA-PLGGAARALAHGVRVLE DGVNYATGNLPG (SEQ ID NO:63); and has a length of 171 amino acids. Such a polytope can include core T-cell epitopes designated Core-1, Core-2, Core-3, Core-4, Core-5, Core-6, Core-7, Core-8, Core-9, Core-10, Core-11, Core-12, Core-13, Core-14, Core-16, Core-17, Core-18, Core-19, Core-20, Core-21, Core-22 in FIG. 13A and FIGS. 15A-15N.

HCV p7 T-Cell Epitopes

In some cases, the heterologous polypeptide present in an E2 variant polypeptide of an E1/E2 heterodimer of the present disclosure includes one or more T-cell epitopes present in an HCV p7 polypeptide. Examples of T-cell epitopes present in HCV p7 polypeptides are depicted in FIGS. 15A-15N or FIG. 13A.

As another example, the heterologous polypeptide can comprise an HCV p7 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 803-811 of the amino acid sequence designated "Consensus" in FIGS. 16A-16L, or a corresponding HCV p7 amino acid sequence of any HCV genotype; and the HCV p7 T-cell epitope can have a length of from 9 amino acids (aa) to 15 amino acids (e.g., 9 aa, 10 aa, 11 aa, 12 aa, 13 aa, 14 aa, or 15 aa).

Polytopes Including HCV T-Cell Epitopes from more than One HCV Polypeptide other than E1 and E2

As noted above, a heterologous polypeptide can include T-cell epitopes from more than one HCV polypeptide other than E1 and E2.

As one example, a heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: QASLLKVPYFVRVQGLLRICALARKMAG-GHYVQMAIIKLGALTGTYVYNALTP LRDWAHNGL-RDLAVAVEPVVFSQMETKLITWGADTAACGDI-INGLPVSARRGR EILLGPADGMVSKGWRLLAPITAYAQQTRGLLGCIIT-SLTGRDKNQVEGEVQIVS TAAQTFLATCINGVCWT-VYHGAGTRTIASPKGPVIQMYTNVDQDLVGW-PAPQG ARSLTPCTCGSSDLYLVTRHADVIPVRRRGDSRGSLL-SPRPISYLKGSAGGPLLCP AGHAVGIFRAAVCTRG-VAKAVDFIPVENLETTMRSPVFTDNSSPPAVPQSFQVA HLHAPTGSGKSTKVPAAYAAQGYKVLVLNPSVAATL-GFGAYMSKAHGIDPNIR TGVRTITTGSPITYSTYGK-FLADGGCSGGAYDIIICDECHSTDATSILGIGTVLDQA ETAGARLVVLATATPPGSVTVPHPNIEEVALSTTGEIP-FYGKAIPLEVIKGGRHLIF CHSKKKCDELAAKLVAL-GINAVAYYRGLDVSVIPTSGDVVVVATDALMTGFTG DFDSVIDCN (SEQ ID NO:12); and has a length of from 550 amino acids (aa) to 560 aa (e.g., 550 aa, 551 aa, 552 aa, 553 aa, 554 aa, 555 aa, 556 aa, 557 aa, 558 aa, 559 aa, or 560 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: QASLLKVPYFVRVQGLLRICALARKMAG-GHYVQMAIIKLGALTGTYVYNALTP LRDWAHNGL-RDLAVAVEPVVFSQMETKLITWGADTAACGDI-INGLPVSARRGR EILLGPADGMVSKGWRLLAPITAYAQQTRGLLGCIIT-SLTGRDKNQVEGEVQIVS TAAQTFLATCINGVCWT-VYHGAGTRTIASPKGPVIQMYTNVDQDLVGW-PAPQG ARSLTPCTCGSSDLYLVTRHADVIPVRRRGDSRGSLL-SPRPISYLKGSAGGPLLCP AGHAVGIFRAAVCTRG-VAKAVDFIPVENLETTMRSPVFTDNSSPPAVPQSFQVA HLHAPTGSGKSTKVPAAYAAQGYKVLVLNPSVAATL-GFGAYMSKAHGIDPNIR TGVRTITTGSPITYSTYGK-FLADGGCSGGAYDIIICDECHSTDATSILGIGTVLDQA ETAGARLVVLATATPPGSVTVPHPNIEEVALSTTGEIP-FYGKAIPLEVIKGGRHLIF CHSKKKCDELAAKLVAL- GINAVAYYRGLDVSVIPTSGDVVVVATDALMTGFTG DFDSVIDCN (SEQ ID NO: 12); and has a length of 553 amino acids. Such a polytope can include T-cell epitopes designated NS2-1, NS2-2, NS2-3, NS2-4, NS2-5, NS2-6, NS2-7, NS2-8, NS3-1, NS3-2, NS3-3, NS3-4, NS3-5, NS3-6, NS3-7, NS3-9, NS3-10, NS3-11, NS3-12, and NS3-13 in FIGS. 13A-13B and FIGS. 15A-15N. This polytope is also referred to as "TP553" (FIGS. 14A-14D). In order to prevent self cleavage of the TP553 polytope (amino acids 917-1469) (FIGS. 15E-G) at the NS2-NS3 junction that is mediated by the catalytic domain of the NS2 protease (amino acids 917-1040), the histidine at position 966 (H966), a critical residue for NS2 protease activity, is mutated to alanine (H966A) (FIG. 15E). See, e.g., Grakoui, A. et al. A second hepatitis C virus-encoded proteinase. Proc. Natl Acad. Sci. USA 90, 10583-10587 (1993); Hijikata, M. et al. Two distinct proteinase activities required for the processing of a putative nonstructural precursor protein of hepatitis C virus. J. Virol. 67, 4665-4675 (1993); and Lorenz. IC. Structure of the catalytic domain of the hepatitis C virus NS2-3 protease. Nature. August 17; 442(7104):831-5 (2006).

As another example, the heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 778 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 450 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 778 aa) the following amino acid sequence: LHAPTGSGKSTKVPAAYAAQGYKVLVLNPSVAATLG-FGAYMSKAHGIDPNIRTGVRTIT TGSPITYSTYGK-FLADGGCSGGAYDIIICDECHSTDATSILGIGTV-LDQAETAGARLVVLA TATPPGSVTVPHPNIEEVALSTTGEIPFYGKAIPLEVIK-GGRHLIFCHSKKKCDELAAKLV ALGINAVAYYRGLD-VSVIPTSGDVVVVATDALMTGFTGDFDSVID-CNTCVTQTVDFSLD PTFTIETTTLPQDAVSRTQRRGRTGRGKPGIYR-FVAPGERPSGMFDSSVLCECYDAGCA WYELTPAETT-VRLRAYMNTPGLPVCQDHLEFWEGVFTGLTHIDAH-FLSQTKQSGENLP YLVAYQATVCARAQAPPPSWDQMWKCLIRLKPTLH-GPTPLLYRLGAVQNEVTLTHPIT KYIMTCMSADLEV-VTSTWVLVGGVLAALAAYCLSTGCVVIVGRIVLS-GKPAIIPDREVL YREFDEMEECSQHLPYIEQGMMLAEQFKQKAL-GLLQTASRQAEVIAPAVQTNWQKLEA FWAKHMWN-FISGIQYLAGLSTLPGNPAIASLMA-FTAAVTSPLTTSQTLLFNILGGWVAA QLAAPGAATAFVGAGLAGAAIGSVGLGKVLVDI-LAGYGAGVAGALVAFKIMSGEVPST EDLVNLLPAIL-SPGALVVGVVCAAILRRHVGPGEGAVQWMNRLIA-FASRGNHVSPTHY VPESDAAARVTAILSSLTVTQLLRRLHQWIS-SECTTPCSGSWLRDIWDWICEVLSDFKTW LKAK-LMPQLPG (SEQ ID NO:64). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 778 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 450 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 778 aa) of the following amino acid sequence: LHAPTGSGKSTKVPAAYAAQ-GYKVLVLNPSVAATLGFGAYMSKAHGIDPNIRTGVR-TIT TGSPITYSTYGKFLADGGCSGGAYDIIICDECHST-DATSILGIGTVLDQAETAGARLVVLA TATPPGSVTVPHPNIEEVALSTTGEIPFYGKAIPLEVIK-GGRHLIFCHSKKKCDELAAKLV ALGINAVAYYRGLD-VSVIPTSGDVVVVATDALMTGFTGDFDSVID-CNTCVTQTVDFSLD PTFTIETTTLPQDAVSRTQRRGRTGRGKPGIYR-FVAPGERPSGMFDSSVLCECYDAGCA WYELTPAETT-VRLRAYMNTPGLPVCQDHLEFWEGVFTGLTHIDAH-FLSQTKQSGENLP YLVAYQATVCARAQAPPPSWDQMWKCLIRLKPTLH-GPTPLLYRLGAVQNEVTLTHPIT KYIMTCMSADLEV-VTSTWVLVGGVLAALAAYCLSTGCVVIVGRIVLS-GKPAIIPDREVL YREFDEMEECSQHLPYIEQGMMLAEQFKQKAL-GLLQTASRQAEVIAPAVQTNWQKLEA FWAKHMWN-FISGIQYLAGLSTLPGNPAIASLMA-FTAAVTSPLTTSQTLLFNILGGWVAA QLAAPGAATAFVGAGLAGAAIGSVGLGKVLVDI-LAGYGAGVAGALVAFKIMSGEVPST EDLVNLLPAIL-SPGALVVGVVCAAILRRHVGPGEGAVQWMNRLIA-FASRGNHVSPTHY VPESDAAARVTAILSSLTVTQLLRRLHQWIS-SECTTPCSGSWLRDIWDWICEVLSDFKTW LKAK-LMPQLPG (SEQ ID NO:64); and has a length of from 25 amino acids (aa) to 50 aa, from 50 aa to 100 aa, from 100 aa to 200 aa, from 200 aa to 300 aa, from 300 aa to 400 aa, from 400 aa to 500 aa, from 500 aa to 600 aa, from 600 aa to 700 aa, or from 700 aa to 778 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGS-GKSTKVPAAYAAQGYKVLVLNPSVAATLGFGAYM-SKAHGIDPNIRTGVRTIT TGSPITYSTYGKFLADGGC-SGGAYDIIICDECHSTDATSILGIGTVLDQAETAGAR LVVLA TATPPGSVTVPHPNIEEVALSTTGEIPFYG-KAIPLEVIKGGRHLIFCHSKKKCDELAAKLV ALGI-NAVAYYRGLDVSVIPTSGDVVVVATDALMTGFTGD-FDSVIDCNTCVTQTVDFSLD PTFTIETTTLPQDAVSRTQRRGRTGRGKPGIYR-FVAPGERPSGMFDSSVLCECYDAGCA WYELTPAETT-VRLRAYMNTPGLPVCQDHLEFWEGVFTGLTHIDAH-FLSQTKQSGENLP YLVAYQATVCARAQAPPPSWDQMWKCLIRLKPTLH-GPTPLLYRLGAVQNEVTLTHPIT KYIMTCMSADLEV-VTSTWVLVGGVLAALAAYCLSTGCVVIVGRIVLS-GKPAIIPDREVL YREFDEMEECSQHLPYIEQGMMLAEQFKQKAL-GLLQTASRQAEVIAPAVQTNWQKLEA FWAKHMWN-FISGIQYLAGLSTLPGNPAIASLMA-FTAAVTSPLTTSQTLLFNILGGWVAA QLAAPGAATAFVGAGLAGAAIGSVGLGKVLVDI-LAGYGAGVAGALVAFKIMSGEVPST EDLVNLLPAIL-SPGALVVGVVCAAILRRHVGPGEGAVQWMNRLIA-FASRGNHVSPTHY VPESDAAARVTAILSSLTVTQLLRRLHQWIS-SECTTPCSGSWLRDIWDWICEVLSDFKTW LKAK-LMPQLPG (SEQ ID NO:64); and has a length of 778 amino acids. Such a polytope can include T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS2-14, NS4a-1, NS4b-1, NS4b-2, NS4b-3, NS4b-4, NS4b-5, NS4b-6, NS4b-7, NS4b-8, NS4b-9, and NS4b-10 in FIG. 13B and FIGS. 15A-15N.

As another example, the heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 1985 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 500 aa, from 500 aa to 750 aa, from 750 aa to 1000 aa, from 1000 aa to 1500 aa, or from 1500 aa to 1985 aa) of the following amino acid sequence:

```
                                          (SEQ ID NO: 13)
APITAYAQQTRGLLGCIITSLTGRDKNQVEGEVQIVSTAAQTFLATCING

VCWTVYHGAGTRTIASPKGPVIQMYTNVDQDLVGWPAPQGARSLTPCTCG

SSDLYLVTRHADVIPVRRRGDSRGSLLSPRPISYLKGSAGGPLLCPAGHA

VGIFRAAVCTRGVAKAVDFIPVENLETTMRSPVFTDNSSPPAVPQSFQVA

HLHAPTGSGKSTKVPAAYAAQGYKVLVLNPSVAATLGFGAYMSKAHGIDP

NIRTGVRTITTGSPITYSTYGKFLADGGCSGGAYDIIICDECHSTDATSI

LGIGTVLDQAETAGARLVVLATATPPGSVTVPHPNIEEVALSTTGEIPFY

GKAIPLEVIKGGRHLIFCHSKKKCDELAAKLVALGINAVAYYRGLDVSVI

PTSGDVVVVATDALMTGFTGDFDSVIDCNTCVTQTVDFSLDPTFTIETTT

LPQDAVSRTQRRGRTGRGKPGIYRFVAPGERPSGMFDSSVLCECYDAGCA

WYELTPAETTVRLRAYMNTPGLPVCQDHLEFWEGVFTGLTHIDAHFLSQT

KQSGENLPYLVAYQATVCARAQAPPPSWDQMWKCLIRLKPTLHGPTPLLY

RLGAVQNEVTLTHPITKYIMTCMSADLEVVTSTWVLVGGVLAALAAYCLS

TGCVVIVGRIVLSGKPAIIPDREVLYREFDEMEECSQHLPYIEQGMMLAE

QFKQKALGLLQTASRQAEVIAPAVQTNWQKLEAFWAKHMWNFISGIQYLA

GLSTLPGNPAIASLMAFTAAVTSPLTTSQTLLFNILGGWVAAQLAAPGAA

TAFVGAGLAGAAIGSVGLGKVLVDILAGYGAGVAGALVAFKIMSGEVPST

EDLVNLLPAILSPGALVVGVVCAAILRRHVGPGEGAVQWMNRLIAFASRG

NHVSPTHYVPESDAAARVTAILSSLTVTQLLRRLHQWISSECTTPCSGSW

LRDIWDWICEVLSDFKTWLKAKLMPQLPGIPFVSCQRGYRGVWRGDGIMH

TRCHCGAEITGHVKNGTMRIVGPRTCRNMWSGTFPINAYTTGPCTPLPAP
```

-continued

NYTFALWRVSAEEYVEIRQVGDFHYVTGMTTDNLKCPCPQVPSPEFFTELD

GVRLHRFAPPCKPLLREEVSFRVGLHEYPVGSQLPCEPEPDVAVLTSMLT

DPSHITAEAAGRRLARGSPPSVASSSASQLSAPSLKATCTANHDSPDAEL

IEANLLWRQEMGGNITRVESENKVVILDSFDPLVAEEDEREISVPAEILR

KSRRFAPALPIWARPDYNPPLLETWKKPDYEPPVVHGCPLPPPQSPPVPP

PRKKRTVVLTESTVSTALAELATKSFGSSSTSGITGDNTTTSSEPAPSGC

PPDSDAESYSSMPPLEGEPGDPDLSDGSWSTVSSEADTEDVVCCSMSYSW

TGALVTPCAAEEQKLPINALSNSLLRHHNLVYSTTSRSACQRQKKVTFDR

LQVLDSHYQDVLKEVKAAASKVKANLLSVEEACSLTPPHSAKSKFGYGAK

DVRCHARKAVNHINSVWKDLLEDSVTPIDTTIMAKNEVFCVQPEKGGRKP

ARLIVFPDLGVRVCEKMALYDVVSKLPLAVMGSSYGFQYSPGQRVEFLVQ

AWKSKKTPMGFSYDTRCFDSTVTESDIRTEEAIYQCCDLDPQARVAIKSL

TERLYVGGPLTNSRGENCGYRRCRASGVLTTSCGNTLTCYIKARAACRAA

GLQDCTMLVCGNNLVVICESAGVQEDAASLRAFTEAMTRYSAPPGDPPQP

EYDLELITSCSSNVSVAHDGAGKRVYYLTRDPTTPLARAAWETARHTPVN

SWLGNIIMFAPTLWARMILMTHFFSVLIARDQLEQALDCEIYGACYSIEP

LDLPPIIQRLHGLSAFSLHSYSPGEINRVAACLRKLGVPPLRAWRHRARS

VRARLLSRGGRAAICGKYLFNWAVRTKLKLTPIAAAGQLDLSGWFTAGYS

GGDIYHSVSHARPRWFWFCLLLLAAGVGIYLLPNR.

In some cases, the heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: APITAYAQQTRGLLGCIITSLTGRDKNQVEG-EVQIVSTAAQTFLATCINGVCWTV YHGAGTRTIASP-KGPVIQMYTNVDQDLVGWPAPQGARSLTPCTCGSS-DLYLVT RHADVIPVRRRGDSRGSLLSPRPISYLKGS AGGPLLCPAGHAVGIFRAAVCTRGV AKAVDFIPVEN-LETTMRSPVFTDNSSPPAVPQSFQVAHLHAPTGSGK-STKVPAA YAAQGYKVLVLNPSVAATLGFGAYM-SKAHGIDPNIRTGVRTITTGSPITYSTYG KFLADGGCSGGAYDIIICDECHSTDATSILGIGTV-LDQAETAGARLVVLATATPP GSVTVPHPNIEEVALST-TGEIPFYGKAIPLEVIKGGRHLIFCHSKKKCDE-LAAKLV ALGINAVAYYRGLDVSVIPTSGDVVVVATDALMTG-FTGDFDSVIDCNTCVTQT VDFSLDPTFTIETTTLPQ-DAVSRTQRRGRTGRGKPGIYRFVAPGERPSGMFDSSV LCECYDAGCAWYELTPAETTVRLRAYMNTPGLPVC-QDHLEFWEGVFTGLTHID AHFLSQTKQSGENLPYL-VAYQATVCARAQAPPPSWDQMWKCLIRLKPTLHGPT PLLYRLGAVQNEVTLTHPITKYIMTCMSADLEV-VTSTWVLVGGVLAALAAYCL STGCVVIVGRIVLS-GKPAIIPDREVLYREFDEMEECSQHLPYIEQGMM-LAEQFKQ KALGLLQTASRQAEVIAPAVQTNWQKLEAFWAKHM-WNFISGIQYLAGLSTLPG NPAIASLMA-FTAAVTSPLTTSQTLLFNILGGWVAAQLAAP-GAATAFVGAGLAGA AIGSVGLGKVLVDILAGYGAGVAGALVAFKIMS-GEVPSTEDLVNLLPAILSPGAL VVGVVCAAILR-RHVGPGEGAVQWMNRLIAFASRGNHVSPTHYVPES-DAAARV TAILSSLTVTQLLRRLHQWISSECTTPCSGSWLRDI-WDWICEVLSDFKTWLKAKL MPQLPGIPFVSCQR-GYRGVWRGDGIMHTRCHCGAEITGHVKNGTM-RIVGPRTC RNMWSGTFPINAYTTGPCTPLPAPNYTFALWRV-SAEEYVEIRQVGDFHYVTGM TTDNLKCPCQVPSP-EFFTELDGVRLHRFAPPCKPLLREEVSFRVGL-HEYPVGSQL PCEPEPDVAVLTSMLTDPSHITAEAAGRRLARGSPPS-VASSSASQLSAPSLKATCT ANHDSPDAELIEANLL-WRQEMGGNITRVESENKVVILDSFDPLVAEEDER-EISVP AEILRKSRRFAPALPIWARPDYNPPLLETWKKPDYEP-PVVHGCPLPPPQSPPVPPP RKKRTVVLTESTVSTA-LAELATKSFGSSSTSGITGDNTTTSSEPAPSGCPPDS-DAE SYSSMPPLEGEPGDPDLSDGSWSTVSSEADTEDV-VCCSMSYSWTGALVTPCAAE EQKLPINALSNSLL-RHHNLVYSTTSRSACQRQKKVTFDRLQVLDSHYQD-VLKEV KAAASKVKANLLSVEEACSLTPPHSAKSKFGY-GAKDVRCHARKAVNHINSVW KDLLEDSVTPIDTTI-MAKNEVFCVQPEKGGRKPARLIVFPDLGVRVCEK-MALYD VVSKLPLAVMGSSYGFQYSPGQRVEFLVQAWKSKK-TPMGFSYDTRCFDSTVTE SDIRTEEAIYQCCDLD-PQARVAIKSLTERLYVGGPLTNSRGENCGYRRCRAS-GVL TTSCGNTLTCYIKARAACRAAGLQDCTMLVCG NNLVVICESAGVQEDAASLRA FTEAMTRYSAPPGDP-PQPEYDLELITSCSSNVSVAHDGAGKRVYYLTRDPTT-PLA RAAWETARHTPVNSWLGNIIMFAPTLWARM-ILMTHFFSVLIARDQLEQALDCEI YGACYSIEPLDLPPIIQRLHGLSAFSLHSYSPGEIN-RVAACLRKLGVPPLRAWRHR ARSVRARLLSRG-GRAAICGKYLFNWAVRTKLKLTPIAAAGQLDLSGW-FTAGYS GGDIYHSVSHARPRWFWFCLLLLAAGVGIYLLPNR (SEQ ID NO:13); and has a length of 1985 amino acids. Such a polytope can include T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10, NS5a-1, NS5a-2, NS5b-1, NS5b-2 in FIGS. 13A-13B and FIGS. 15A-15N.

Additional T-Cell Epitopes

As discussed above, an E1/E2 a heterodimeric polypeptide of the present disclosure includes: a) an HCV E1 polypeptide; and b) a variant HCV E2 polypeptide comprising: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein.

Thus, in some cases, a variant HCV E2 polypeptide of an E1/E2 heterodimer of the present disclosure includes: a) an HCV E2 polypeptide; and b) a heterologous polypeptide that comprises one or more T-cell epitopes, where the one or more T-cell epitopes are T-cell epitopes present in: i) one or more of an HCV NS3 polypeptide, an HCV NS2 polypeptide, an HCV NS4A polypeptide, an HCV NS4B polypeptide, an HCV NS5A polypeptide, an HCV NS5B polypeptide, an HCV core polypeptide, and an HCV p7 polypeptide; and ii) one or more of cholera toxin or toxoid, tetanus toxin or toxoid, diphtheria toxin or toxoid, and a meningococcal outer membrane protein.

A T helper tetanus toxin epitope or other bacterial T-cell epitope could be fused (e.g., by recombinant expression) or chemically conjugated to the HCV polytope/E2 fusion protein and/or to the HCV polytope E1 fusion protein of an E1/E2 heterodimer of the present disclosure to further enhance both T and B cell responses to both the HCV polytope and E1/E2 moieties. Alternatively, the whole or part of the detoxified toxin ("toxoid") could be fused (e.g., by recombinant expression) or chemically conjugated to the HCV polytope/E1E2 protein, wherein specific amino acids of the toxins are mutated to render the toxins inactive, thereby generating toxoids. Methods of generating toxoids are well known in the art. Examples of bacterial epitopes include the use of diphtheria toxoid, meningococcal outer membrane protein, or mutant diphtheria protein CRM197 (see, e.g.: www(dot)medscape(dot)com/viewarticle/431127)

In some cases, a suitable tetanus toxoid polypeptide comprises the amino acid sequence QYIKANSKFIGIFE (SEQ ID NO: 14). In some cases, a suitable tetanus toxoid polypeptide comprises the amino acid sequence QYIKANSKFIGITE (SEQ ID NO:65).

In some cases, a heterologous polypeptide can comprise cholera toxin (or toxoid) epitope. In some cases, a suitable heterologous polypeptide comprising a cholera toxoid epitope comprises a fragment of cholera toxin-B subunit (CT-B), e.g., a fragment of from 5 amino acids to 25 amino acids, or from 25 amino acids to 50 amino acids, of the following amino acid sequence: MIKLKFGVFF TVLLSSAYAH GTPQNITDLC AEYHNTQIHT LNDKIFSYTE SLAGKREMAI ITFKNGATFQ VEVPGSQHID SQKKAIERMK DTLRIAYLTE AKVEKLCVWN NKTPHAIAAI SMAN (SEQ ID NO:15).

In some cases, a heterologous polypeptide can comprise a tetanus toxin (or toxoid) T-cell epitope. In some cases, a suitable heterologous polypeptide comprising a tetanus toxin T-cell epitope comprises the amino acid sequence: ILMQYIKANSKFIGI (SEQ ID NO:16); and has a length of from 15 amino acids to 20 amino acids. In some cases, a suitable heterologous polypeptide comprising a tetanus toxin T-cell epitope comprises the amino acid sequence: VNNESSE (SEQ ID NO: 17). In some cases, a suitable heterologous polypeptide comprising a tetanus toxin T-cell epitope comprises the amino acid sequence: PGINGKAIHLVNNESSE (SEQ ID NO: 18). In some cases, a suitable heterologous polypeptide comprising a tetanus toxin T-cell epitope comprises the amino acid sequence: PNRDIL (SEQ ID NO: 19). In some cases, a suitable heterologous polypeptide comprising a tetanus toxin T-cell epitope comprises the amino acid sequence: FIGITEL (SEQ ID NO:20). In some cases, a suitable tetanus toxin T-cell epitope comprises the amino acid sequence: SYFPSV (SEQ ID NO:21). In some cases, a suitable heterologous polypeptide comprising a tetanus toxin T-cell epitope comprises the amino acid sequence: NSVDDALINSTKIYSYFPSV (SEQ ID NO:22). In some cases, a suitable heterologous polypeptide comprising a tetanus toxin T-cell epitope comprises the amino acid sequence: IDKISDVSTIVPYIGPALNI (SEQ ID NO:23).

In some cases, a heterologous polypeptide can comprise a diphtheria toxin T-cell epitope In some cases, a suitable heterologous polypeptide comprising a diphtheria toxin T-cell epitope comprises the amino acid sequence: QSIALSSLMVAQAIP (SEQ ID NO:24); and has a length of from 15 amino acids to 20 amino acids. In some cases, a suitable heterologous polypeptide comprising a diphtheria toxin T-cell epitope comprises the amino acid sequence: PVFAGANYAAWAVNVAQVI (SEQ ID NO:25). In some cases, a suitable heterologous polypeptide comprising a diphtheria toxin T-cell epitope comprises the amino acid sequence: VHHNTEEIVAQSIALSSLMV (SEQ ID NO:26). In some cases, a suitable heterologous polypeptide comprising a diphtheria toxin T-cell epitope comprises the amino acid sequence: QSIALSSLMVAQAIPLVGEL (SEQ ID NO:66). In some cases, a suitable heterologous polypeptide comprising a diphtheria toxin T-cell epitope comprises the amino acid sequence: VDIGFAAYNFVESIINLFQV (SEQ ID NO:67). In some cases, a suitable heterologous polypeptide comprising a diphtheria toxin T-cell epitope comprises the amino acid sequence: QGESGHDIKITAENTPLPIA (SEQ ID NO:68). In some cases, a suitable heterologous polypeptide comprising a diphtheria toxin T-cell epitope comprises the amino acid sequence: GVLLPTIPGKLDVNKSKTHI (SEQ ID NO:69). In some cases, a suitable heterologous polypeptide comprising a diphtheria toxin T-cell epitope comprises the amino acid sequence of CRM197 (see, e.g., Giannini et al. (1984) Nucl. Acids. Res. 12:4063).

The amino acid sequence of CRM197 is as follows:
laddvvdssksfvmenfssyhgtkpgyvdsiqkgiqkpksgtqgnyddwkefystdnky daagysvdnenplsgkaggvvkvtypgltkvlalkvdnaetikkelglsteplmeqvgteefikrfgdgasrvvlslpfae gsssveyinnweqakalsveleinfetrgkrgqdamyeymaqacagnrvrrsvgsslscinl dwdvirdktktkieslkeh gpiknkmsespnktvseekakqyleefhqtalehpelselktvtgtnpvfaganyaawavnvaqvidsetadnlekttaal silpgigsvmgiadgavhhnteeivaqsialsslmvaqaiplvgelvdigfaaynfvesiinlfqvvhnsynrpayspghkt qpflhdgyavswntvedsiirtgfqgesghdikitaentplpiagvllptipgkldvnkskthisvngrkirmrcraidgdvtf crpkspvyvgngvhanlhvafhrsssekihsneissdsigvlgyqktvdhtkvnsklslffeiks (SEQ ID NO:27).

In some cases, a heterologous polypeptide can comprise a tetanus toxin T-cell epitope and a diphtheria toxin T-cell epitope. In some of these cases, the heterologous polypeptide can comprise the amino acid sequence: IMQYIKANSKFIGIQSIALSSLMVAQ (SEQ ID NO:28); and can have a length of from 26 amino acids to 30 amino acids.

E1

An HCV E1 polypeptide suitable for inclusion in an E1/E2 heterodimer of the present disclosure can have a length of from about 150 amino acids (aa) to about 175 aa, from about 175 aa to about 195 aa, from about 131 aa to about 175 aa, or from about 175 aa to about 193 aa. In some cases, an HCV E1 polypeptide suitable for inclusion in an E1/E2 heterodimer of the present disclosure is an HCV E1 ectodomain polypeptide. In some cases, an HCV E1 polypeptide suitable for inclusion in an E1/E2 heterodimer of the present disclosure is a full-length HCV E1 polypeptide.

In FIGS. 1A-1C, the amino acid sequence of E1 is amino acid 192 to amino acid 383. In FIGS. 2A-2C, the amino acid sequence of E1 is amino acid 192 to amino acid 383. In FIGS. 3A-3C, the amino acid sequence of E1 is amino acid 192 to amino acid 384. In FIGS. 4A-4B, the amino acid sequence of E1 is amino acid 192 to amino acid 383. Amino acids at around 170 through approximately 191 serve as a signal sequence for E1. As used herein, "E1 polypeptide" includes a precursor E1 protein, including the signal sequence; includes a mature E1 polypeptide which lacks this sequence; and includes an E1 polypeptide with a heterologous signal sequence. An E1 polypeptide can include a C-terminal membrane anchor sequence which occurs at approximately amino acid positions 360-383 (see, e.g., WO 96/04301). In some cases, a suitable E1 polypeptide lacks a C-terminal portion that includes a transmembrane region. For example, in some cases, a suitable E1 polypeptide lacks the C-terminal portion from amino acid 330 to amino acid 384, or from amino acid 360 to amino acid 384. E1 polypeptides can be an E1 polypeptide of any genotype, subtype or isolate of HCV. E1 polypeptides of genotype 1 and E1 polypeptides of genotype 3 are included in an E1/E2 heterodimer of the present disclosure.

An E1 polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIGS. 1A-1C, FIGS. 2A-2C, FIGS. 3A-3C, or FIGS. 4A-4B.

An E1 polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIGS. 1A-1C. For example, an E1 polypeptide of genotype 1A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 1A and depicted in FIGS. 1A-1C. For example, an E1 polypeptide of genotype 1B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 1B and depicted in FIGS. 1A-1C. For example, an E1 polypeptide of genotype 1C can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 1C and depicted in FIGS. 1A-1C.

An E1 polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIGS. 2A-2C. For example, an E1 polypeptide of genotype 2A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 2A and depicted in FIGS. 2A-2C. For example, an E1 polypeptide of genotype 2B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 2B and depicted in FIGS. 2A-2C.

An E1 polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the consensus E1 polypeptide amino acid sequence depicted in FIGS. 3A-3C.

An E1 polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIGS. 4A-4B. For example, an E1 polypeptide of genotype 7A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of the amino acid sequence depicted in FIGS. 4A-4B.

Additional Polypeptides

In any of the above-described embodiments, one or both of the polypeptide chains of the E1/E2 heterodimer can include one or more additional polypeptides. For example, in some cases, the E1 polypeptide or the variant E2 polypeptide can include an Ig Fc polypeptide at the C-terminus of the E1 polypeptide or the variant E2 polypeptide. As another example, in some cases, the E1 polypeptide or the variant E2 polypeptide can include an Ig Fc polypeptide at the N-terminus of the E1 polypeptide or the variant E2 polypeptide. Ig Fc polypeptides are known in the art, and are described elsewhere herein.

IB. E1E2 Heterodimers Comprising a Variant HCV E1 and HCV E2

The present disclosure provides an E1/E2 heterodimer, where the E1/E2 heterodimer comprises: a) a variant HCV E1 polypeptide, where the variant HCV E1 polypeptide comprises: i) an HCV E1 polypeptide; and ii) a heterologous polypeptide that comprises one or more T-cell epitopes (e.g., one or more T-cell epitopes not present in an HCV E1 or an HCV E2 polypeptide; e.g., one or more T-cell epitopes present in an HCV polypeptide other than an HCV E1 or an HCV E2 polypeptide); and b) an HCV E2 polypeptide. Thus, in some cases, a heterodimeric polypeptide of the present disclosure includes: a) an HCV E2 polypeptide; and b) a variant HCV E1 polypeptide comprising: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein. The heterologous polypeptide is also referred to as a "polytope."

An E1/E2 heterodimer of the present disclosure (e.g., an E1/E2 heterodimer comprising: a) an HCV E2 polypeptide; and b) a variant HCV E2 polypeptide comprising: i) an HCV E2 polypeptide; and ii) a heterologous polypeptide comprising one or more T-cell epitopes), when administered to an individual in need thereof, induces an immune response in the individual to one or more HCV genotypes. An E1/E2 heterodimer of the present disclosure, when administered to an individual in need thereof, induces an immune response in the individual to one or more HCV genotypes, where the immune response is greater than the immune response induced by administration of an HCV E1/E2 heterodimer comprising a wild-type E2 and a wild-type E1 polypeptide or an E1 polypeptide lacking the polytope.

For example, in some cases, an E1/E2 heterodimer of the present disclosure (e.g., an E1/E2 heterodimer comprising: a) an HCV E2 polypeptide; and b) a variant HCV E1 polypeptide comprising: i) an HCV E1 polypeptide; and ii) a heterologous polypeptide comprising one or more T-cell epitopes), when administered to an individual in need thereof, induces CTLs specific for HCV, where the number of HCV-specific CTLs induced is at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, higher than the number of HCV-specific CTLs induced by administration of an HCV E1/E2 heterodimer comprising a wild-type E2 and a wild-type E1 polypeptide or an E1 polypeptide lacking the polytope.

In some cases, an E1/E2 heterodimer of the present disclosure (e.g., an E1/E2 heterodimer comprising: a) an HCV E2 polypeptide; and b) a variant HCV E1 polypeptide comprising: i) an HCV E1 polypeptide; and ii) a heterologous polypeptide comprising one or more T-cell epitopes present in an HCV polypeptide other than an HCV E1 polypeptide or an HCV E2 polypeptide), when administered to an individual in need thereof, induces production of HCV-specific $CD4^+$ T cells and $CD8^+$ T cells in the individual, where the number of HCV-specific $CD4^+$ T cells and $CD8^+$ T cells is increased, such that the percent of the total peripheral blood T cells (i.e., the total number of $CD4^+$ T cells+$CD8^+$ T cells in the peripheral blood) that are HCV-specific CD4+ T cells and $CD8^+$ T cells is from 0.5% to 10% (e.g., from 0.5% to 1%, from 1% to 2%, from 2% to 5%, or from 5% to 10%). The number of HCV-specific $CD4^+$ T cells and $CD8^+$ T cells in a control individual (e.g., an individual not infected with HCV) not treated with the E1/E2 heterodimer would be undetectable.

For example, in some cases, an E1/E2 heterodimer of the present disclosure (e.g., an E1/E2 heterodimer comprising: a) an HCV E2 polypeptide; and b) a variant HCV E1 polypeptide comprising: i) an HCV E1 polypeptide; and ii) a heterologous polypeptide comprising one or more HCV NS3 T-cell epitopes), when administered to an individual in need thereof, induces production of HCV NS3-specific $CD4^+$ T cells and $CD8^+$ T cells in the individual, where the number of HCV NS3-specific $CD4^+$ T cells and $CD8^+$ T cells is increased, such that the percent of the total peripheral blood T cells (i.e., the total number of $CD4^+$ T cells+$CD8^+$ T cells in the peripheral blood) that are HCV NS3-specific $CD4^+$ T cells and $CD8^+$ T cells is from 0.1% to 10% (e.g., from 0.1% to 0.5%, from 0.5% to 1%, from 1% to 2%, from 2% to 5%, or from 5% to 10%). The number of HCV NS3-specific $CD4^+$ T cells and $CD8^+$ T cells in a control individual (e.g., an individual not infected with HCV) not treated with the E1/E2 heterodimer would be undetectable.

In some cases, an E1/E2 heterodimer of the present disclosure (e.g., an E1/E2 heterodimer comprising: a) an HCV E2 polypeptide; and b) a variant HCV E1 polypeptide comprising: i) an HCV E1 polypeptide; and ii) a heterologous polypeptide comprising one or more T-cell epitopes present in an HCV polypeptide other than an HCV E1 polypeptide or an HCV E2 polypeptide), when administered to an individual in need thereof, increases the number of HCV E1/E2-specific $CD4^+$ T cells and $CD8^+$ T cells in the individual by at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, compared to the number of HCV E1/E2-specific $CD4^+$ T cells and $CD8^+$ T cells in the individual induced by administration of an E1/E2 heterodimer comprising a wild-type E2 polypeptide and a wild-type E1 polypeptide, or an E1 polypeptide lacking the polytope, or compared to the number of HCV E1/E2-specific $CD4^+$ T cells and $CD8^+$ T cells in the individual before administration of the E1/E2 heterodimer of the present disclosure.

As another example, in some cases, an E1/E2 heterodimer of the present disclosure (e.g., an E1/E2 heterodimer comprising: a) an HCV E2 polypeptide; and b) a variant HCV E1 polypeptide comprising: i) an HCV E1 polypeptide; and ii) a heterologous polypeptide comprising one or more T-cell epitopes present in an HCV polypeptide other than an HCV E1 polypeptide or an HCV E2 polypeptide), when administered to an individual in need thereof, induces helper T lymphocytes (e.g., $CD4^+$ T cells) specific for HCV, where the number of HCV-specific helper T lymphocytes induced is at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, higher than the number of HCV-specific helper T cells induced by administration of an E1/E2 heterodimer comprising a wild-type E2 polypeptide and a wild-type E1 polypeptide, or an E1 polypeptide lacking the polytope, or compared to the number of HCV-specific helper T cells in the individual before administration of the E1/E2 heterodimer of the present disclosure.

In some cases, an E1/E2 heterodimer of the present disclosure (e.g., an E1/E2 heterodimer comprising: a) an HCV E2 polypeptide; and b) a variant HCV E1 polypeptide comprising: i) an HCV E1 polypeptide; and ii) a heterologous polypeptide comprising one or more T-cell epitopes present in an HCV polypeptide other than an HCV E1 polypeptide or an HCV E2 polypeptide), when administered to an individual in need thereof, induces antibody specific for HCV, where the level of HCV-specific antibody induced is at least at high as the level of HCV-specific antibody induced by administration of an E1/E2 heterodimer comprising a wild-type E2 polypeptide and a wild-type E1 polypeptide, or an E1 polypeptide lacking the polytope.

In some cases, an E1/E2 heterodimer of the present disclosure (e.g., an E1/E2 heterodimer comprising: a) an HCV E2 polypeptide; and b) a variant HCV E1 polypeptide comprising: i) an HCV E1 polypeptide; and ii) a heterologous polypeptide comprising one or more T-cell epitopes present in an HCV polypeptide other than an HCV E1 polypeptide or an HCV E2 polypeptide), when administered to an individual in need thereof, induces antibody specific for HCV, where the level of HCV-specific antibody induced is at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, higher than the level of HCV-specific antibody induced by administration of an E1/E2 heterodimer comprising a wild-type E2 polypeptide and a wild-type E1 polypeptide, or an E1 polypeptide lacking the polytope.

An E1/E2 heterodimer of the present disclosure (e.g., an E1/E2 heterodimer comprising: a) an HCV E2 polypeptide; and b) a variant HCV E1 polypeptide comprising: i) an HCV E1 polypeptide; and ii) a heterologous polypeptide comprising one or more T-cell epitopes present in an HCV polypeptide other than an HCV E1 polypeptide or an HCV E2 polypeptide), when administered to an individual in need thereof, induces an immune response (e.g., a cellular immune response) in the individual to one or more HCV genotypes. In some cases, an E1/E2 heterodimer of the present disclosure (e.g., an E1/E2 heterodimer comprising: a) an HCV E2 polypeptide; and b) a variant HCV E1 polypeptide comprising: i) an HCV E1 polypeptide; and ii) a heterologous polypeptide comprising one or more T-cell epitopes present in an HCV polypeptide other than an HCV E1 polypeptide or an HCV E2 polypeptide), when administered to an individual in need thereof, induces an immune response in the individual to HCV genotype 1. In some cases, an E1/E2 heterodimer of the present disclosure (e.g., an E1/E2 heterodimer comprising: a) an HCV E2 polypeptide; and b) a variant HCV E1 polypeptide comprising: i) an HCV E1 polypeptide; and ii) a heterologous polypeptide comprising one or more T-cell epitopes present in an HCV polypeptide other than an HCV E1 polypeptide or an HCV E2 polypeptide), when administered to an individual in need thereof, induces an immune response in the individual to HCV genotype 2. In some cases, an E1/E2 heterodimer of the present disclosure (e.g., an E1/E2 heterodimer comprising: a) an HCV E2 polypeptide; and b) a variant HCV E1 polypeptide comprising: i) an HCV E1 polypeptide; and ii) a heterologous polypeptide comprising one or more T-cell epitopes present in an HCV polypeptide other than an HCV E1 polypeptide or an HCV E2 polypeptide), when administered to an individual in need thereof, induces an immune response in the individual to HCV genotype 3. In some cases, an E1/E2 heterodimer of the present disclosure (e.g., an E1/E2 heterodimer comprising: a) an HCV E2 polypeptide; and b) a variant HCV E1 polypeptide comprising: i) an HCV E1 polypeptide; and ii) a heterologous polypeptide comprising one or more T-cell epitopes present in an HCV polypeptide other than an HCV E1 polypeptide or an HCV E2 polypeptide), when administered to an individual in need thereof, induces an immune response in the individual to HCV genotype 1 and HCV genotype 3. In some cases, an E1/E2 heterodimer of the present disclosure (e.g., an E1/E2 heterodimer comprising: a) an HCV E2 polypeptide; and b) a variant HCV E1 polypeptide comprising: i) an HCV E1 polypeptide; and ii) a heterologous polypeptide comprising one or more T-cell epitopes present in an HCV polypeptide other than an HCV E1 polypeptide or an HCV E2 polypeptide), when administered to an individual in need thereof, induces an immune response in the individual to HCV genotype 1, HCV genotype 2, and HCV genotype 3. In some cases, an E1/E2 heterodimer of the present disclosure (e.g., an E1/E2 heterodimer comprising: a) an HCV E2 polypeptide; and b) a variant HCV E1 polypeptide comprising: i) an HCV E1 polypeptide; and ii) a heterologous polypeptide comprising one or more T-cell epitopes present in an HCV polypeptide other than an HCV E1 polypeptide or an HCV E2 polypeptide), when administered to an individual in need thereof, induces an immune response in the individual to HCV genotype 1, HCV genotype 2, HCV genotype 3, and HCV genotype 7. In some cases, an E1/E2 heterodimer of the present disclosure (e.g., an E1/E2 heterodimer comprising: a) an HCV E2 polypeptide; and b) a variant HCV E1 polypeptide comprising: i) an HCV E1 polypeptide; and ii) a heterologous polypeptide comprising one or more T-cell epitopes present in an HCV polypeptide other than an HCV E1 polypeptide or an HCV E2 polypeptide), when administered to an individual in need thereof, induces an immune response in the individual to HCV genotype 1, HCV genotype 2, HCV genotype 3, HCB genotype 4, HCV genotype 5, HCV genotype 6, and HCV genotype 7.

Variant E1

As noted above, a variant E1 polypeptide of an HCV E1/E2 heterodimer of the present disclosure comprises: i) an HCV E1 polypeptide; and ii) a heterologous polypeptide comprising one or more T cell epitopes (e.g., one or more T-cell epitopes not present in an HCV E1 or an HCV E2 polypeptide; e.g., one or more T-cell epitopes present in an HCV polypeptide other than an HCV E1 or an HCV E2 polypeptide). In some cases, the variant HCV E1 polypeptide comprises, in order from amino terminus (N-terminus) to carboxyl terminus (C-terminus): i) an HCV E1 polypeptide; and ii) a heterologous polypeptide comprising one or more T cell epitopes. In some cases, the variant HCV E1 polypeptide comprises, in order from N-terminus to C-terminus: i) a heterologous polypeptide comprising one or more T cell epitopes; and ii) an HCV E1 polypeptide.

E1

An HCV E1 polypeptide suitable for inclusion in a variant E1 polypeptide of an E1/E2 heterodimer of the present disclosure can have a length of from about 150 amino acids (aa) to about 175 aa, from about 175 aa to about 195 aa, from about 131 aa to about 175 aa, or from about 175 aa to about 193 aa. In some cases, an HCV E1 polypeptide suitable for inclusion in a variant E1 polypeptide of an E1/E2 heterodimer of the present disclosure is an HCV E1 ectodomain polypeptide. In some cases, an HCV E1 polypeptide suitable for inclusion in a variant E1 polypeptide of an E1/E2 heterodimer of the present disclosure is a full-length HCV E1 polypeptide.

In FIGS. 1A-1C, the amino acid sequence of E1 is amino acid 192 to amino acid 383. In FIGS. 2A-2C, the amino acid sequence of E1 is amino acid 192 to amino acid 383. In FIGS. 3A-3C, the amino acid sequence of E1 is amino acid 192 to amino acid 384. In FIGS. 4A-4B, the amino acid sequence of E1 is amino acid 192 to amino acid 383. Amino acids at around 170 through approximately 191 serve as a signal sequence for E1. As used herein, "E1 polypeptide" includes a precursor E1 protein, including the signal sequence; includes a mature E1 polypeptide which lacks this sequence; and includes an E1 polypeptide with a heterologous signal sequence. An E1 polypeptide can include a C-terminal membrane anchor sequence which occurs at approximately amino acid positions 360-383 (see, e.g., WO 96/04301). In some cases, a suitable E1 polypeptide lacks a C-terminal portion that includes a transmembrane region. For example, in some cases, a suitable E1 polypeptide lacks the C-terminal portion from amino acid 330 to amino acid 384, or from amino acid 360 to amino acid 384. E1 polypeptides can be an E1 polypeptide of any genotype, subtype or isolate of HCV. E1 polypeptides of genotype 1 and E1 polypeptides of genotype 3 are included in an E1/E2 heterodimer of the present disclosure.

An E1 polypeptide suitable for inclusion in a variant E1 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIGS. 1A-1C, FIGS. 2A-2C, FIGS. 3A-3C, or FIGS. 4A-4B.

An E1 polypeptide suitable for inclusion in a variant E1 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIGS. 1A-1C. For example, an E1 polypeptide of genotype 1A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 1A and depicted in FIGS. 1A-1C. For example, an E1 polypeptide of genotype 1B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 1B and depicted in FIGS. 1A-1C. For example, an E1 polypeptide of genotype 1C can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 1C and depicted in FIGS. 1A-1C.

An E1 polypeptide suitable for inclusion in a variant E1 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIGS. 2A-2C. For example, an E1 polypeptide of genotype 2A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 2A and depicted in FIGS. 2A-2C. For example, an E1 polypeptide of genotype 2B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 2B and depicted in FIGS. 2A-2C.

An E1 polypeptide suitable for inclusion in a variant E1 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the consensus E1 polypeptide amino acid sequence depicted in FIGS. 3A-3C.

An E1 polypeptide suitable for inclusion in a variant E1 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIGS. 4A-4B. For example, an E1 polypeptide of genotype 7A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of the amino acid sequence depicted in FIGS. 4A-4B.

Heterologous Polypeptide

In some cases, the heterologous polypeptide comprises 1, 2, 3, 4, 5, 6, 7, 8, 9, or 10, or more than 10 (e.g., from 10 to 15, from 15 to 20, from 20 to 25, or from 25 to 30, or more than 30), T cell epitopes. T-cell epitopes are epitopes that, when presented with a major histocompatibility complex (MHC) (e.g., a human leukocyte antigen (HLA)) Class I or MHC Class II molecule, are recognized and bound by a T-cell receptor (TCR) present on a T cell surface. T-cell epitopes include epitopes recognized by cytotoxic T cells (e.g., CD8$^+$ T cells), and epitopes recognized by helper T cells (e.g., CD4$^+$ T cells).

The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein. Other examples of strong T helper epitopes are diphtheria toxoid, tetanus toxoid, meningococcal outer membrane protein, or mutant diphtheria protein CRM197 (see, e.g.: www(dot)medscape(dot)com/viewarticle/431127).

In some cases, the heterologous polypeptide comprises a single T-cell epitope. In some cases, the heterologous polypeptide comprises a single HCV-NS3 T-cell epitope. In some cases, the heterologous polypeptide comprises 2 or more T-cell epitopes. In some cases, the heterologous polypeptide comprises 2 or more HCV-NS3 T-cell epitopes. In some cases, the heterologous polypeptide comprises 3 or more HCV-NS3 T-cell epitopes. In some cases, the heterologous polypeptide comprises 4 or more HCV-NS3 T-cell epitopes. In some cases, the heterologous polypeptide comprises a single HCV-NS3 CD4$^+$ T-cell epitope. In some cases, the heterologous polypeptide comprises 2 or more HCV-NS3 CD4$^+$ T-cell epitopes. In some cases, the heterologous polypeptide comprises one or more HCV CD8$^+$ T cell epitopes. In some cases, the heterologous polypeptide comprises a single HCV-NS3 CD8$^+$ T-cell epitope. In some cases, the heterologous polypeptide comprises 2 or more HCV-NS3 CD8$^+$ T-cell epitopes. In some cases, the heterologous polypeptide comprises at least one HCV CD4$^+$ T cell epitope and at least one HCV CD8$^+$ T cell epitope. In some cases, the heterologous polypeptide comprises at least one HCV-NS3 CD4$^+$ T cell epitope and at least one HCV-NS3 CD8$^+$ T cell epitope. In some cases, heterologous polypeptide comprises 2 or more HCV-NS3 CD4$^+$ T-cell epitopes and 2 or more HCV-NS3 CD8$^+$ T-cell epitopes. In some cases, the heterologous polypeptide comprises 2, 3, 4, or 5 HCV-NS3 CD4$^+$ T-cell epitopes and 2, 3, 4, or 5 HCV-NS3 CD8$^+$ T-cell epitopes.

In some cases, the heterologous polypeptide comprises a single T-cell epitope. In some cases, the heterologous polypeptide comprises a single HCV-NS2 T-cell epitope. In some cases, the heterologous polypeptide comprises 2 or more T-cell epitopes. In some cases, the heterologous polypeptide comprises 2 or more HCV-NS2 T-cell epitopes. In some cases, the heterologous polypeptide comprises 3 or more HCV-NS2 T-cell epitopes. In some cases, the heterologous polypeptide comprises 4 or more HCV-NS2 T-cell epitopes. In some cases, the heterologous polypeptide comprises a single HCV-NS2 CD4$^+$ T-cell epitope. In some cases, the heterologous polypeptide comprises 2 or more HCV-NS2 CD4$^+$ T-cell epitopes. In some cases, the heterologous polypeptide comprises one or more HCV CD8$^+$ T cell epitopes. In some cases, the heterologous polypeptide comprises a single HCV-NS2 CD8$^+$ T-cell epitope. In some cases, the heterologous polypeptide comprises 2 or more HCV-NS2 CD8$^+$ T-cell epitopes. In some cases, the heterologous polypeptide comprises at least one HCV CD4$^+$ T cell epitope and at least one HCV CD8$^+$ T cell epitope. In some cases, the heterologous polypeptide comprises at least one HCV-NS2 CD4$^+$ T cell epitope and at least one HCV-NS2 CD8$^+$ T cell epitope. In some cases, heterologous polypeptide comprises 2 or more HCV-NS2 CD4$^+$ T-cell epitopes and 2 or more HCV-NS2 CD8$^+$ T-cell epitopes. In some cases, the heterologous polypeptide comprises 2, 3, 4, or 5 HCV-NS2 CD4$^+$ T-cell epitopes and 2, 3, 4, or 5 HCV-NS2 CD8$^+$ T-cell epitopes.

In some cases, the heterologous polypeptide comprises a single T-cell epitope. In some cases, the heterologous polypeptide comprises a single HCV-NS4A T-cell epitope. In some cases, the heterologous polypeptide comprises 2 or more T-cell epitopes. In some cases, the heterologous polypeptide comprises 2 or more HCV-NS4A T-cell epitopes. In some cases, the heterologous polypeptide comprises 3 or more HCV-NS4A T-cell epitopes. In some cases, the heterologous polypeptide comprises 4 or more HCV-NS4A T-cell epitopes. In some cases, the heterologous polypeptide comprises a single HCV-NS4A CD4$^+$ T-cell epitope. In some cases, the heterologous polypeptide comprises 2 or more HCV-NS4A CD4$^+$ T-cell epitopes. In some cases, the heterologous polypeptide comprises one or more HCV CD8$^+$ T cell epitopes. In some cases, the heterologous polypeptide comprises a single HCV-NS4A CD8$^+$ T-cell epitope. In some cases, the heterologous polypeptide comprises 2 or more HCV-NS4A CD8$^+$ T-cell epitopes. In some cases, the heterologous polypeptide comprises at least one HCV CD4$^+$ T cell epitope and at least one HCV CD8$^+$ T cell epitope. In some cases, the heterologous polypeptide comprises at least one HCV-NS4A CD4$^+$ T cell epitope and at least one HCV-NS4A CD8$^+$ T cell epitope. In some cases, heterologous polypeptide comprises 2 or more HCV-NS4A CD4$^+$ T-cell epitopes and 2 or more HCV-NS4A CD8$^+$ T-cell epitopes. In some cases, the heterologous polypeptide comprises 2, 3, 4, or 5 HCV-NS4A CD4$^+$ T-cell epitopes and 2, 3, 4, or 5 HCV-NS4A CD8$^+$ T-cell epitopes.

In some cases, the heterologous polypeptide comprises a single T-cell epitope. In some cases, the heterologous polypeptide comprises a single HCV-NS5A T-cell epitope. In some cases, the heterologous polypeptide comprises 2 or more T-cell epitopes. In some cases, the heterologous polypeptide comprises 2 or more HCV-NS5A T-cell epitopes. In some cases, the heterologous polypeptide comprises 3 or more HCV-NS5A T-cell epitopes. In some cases, the heterologous polypeptide comprises 4 or more HCV-NS5A T-cell epitopes. In some cases, the heterologous polypeptide comprises a single HCV-NS5A CD4$^+$ T-cell epitope. In some cases, the heterologous polypeptide comprises 2 or more HCV-NS5A CD4$^+$ T-cell epitopes. In some cases, the heterologous polypeptide comprises one or more HCV CD8$^+$ T cell epitopes. In some cases, the heterologous polypeptide comprises a single HCV-NS5A CD8$^+$ T-cell epitope. In some cases, the heterologous polypeptide comprises 2 or more HCV-NS5A CD8+ T-cell epitopes. In some cases, the heterologous polypeptide comprises at least one HCV CD4+ T cell epitope and at least one HCV CD8+ T cell epitope. In some cases, the heterologous polypeptide comprises at least one HCV-NS5A CD4+ T cell epitope and at least one HCV-NS5A CD8+ T cell epitope. In some cases, heterologous polypeptide comprises 2 or more HCV-NS5A CD4+ T-cell epitopes and 2 or more HCV-NS5A CD8+ T-cell epitopes. In some cases, the heterologous polypeptide comprises 2, 3, 4, or 5 HCV-NS5A CD4+ T-cell epitopes and 2, 3, 4, or 5 HCV-NS5A CD8+ T-cell epitopes.

In some cases, the heterologous polypeptide comprises a single T-cell epitope. In some cases, the heterologous polypeptide comprises a single HCV-NS5B T-cell epitope. In some cases, the heterologous polypeptide comprises 2 or more T-cell epitopes. In some cases, the heterologous polypeptide comprises 2 or more HCV-NS5B T-cell epitopes. In some cases, the heterologous polypeptide comprises 3 or more HCV-NS5B T-cell epitopes. In some cases, the heterologous polypeptide comprises 4 or more HCV-NS5B T-cell epitopes. In some cases, the heterologous polypeptide comprises a single HCV-NS5B CD4+ T-cell epitope. In some cases, the heterologous polypeptide comprises 2 or more HCV-NS5B CD4+ T-cell epitopes. In some cases, the heterologous polypeptide comprises one or more HCV CD8+ T cell epitopes. In some cases, the heterologous polypeptide comprises a single HCV-NS5B CD8+ T-cell epitope. In some cases, the heterologous polypeptide comprises 2 or more HCV-NS5B CD8+ T-cell epitopes. In some cases, the heterologous polypeptide comprises at least one HCV CD4+ T cell epitope and at least one HCV CD8+ T cell epitope. In some cases, the heterologous polypeptide comprises at least one HCV-NS5B CD4+ T cell epitope and at least one HCV-NS5B CD8+ T cell epitope. In some cases, heterologous polypeptide comprises 2 or more HCV-NS5B CD4+ T-cell epitopes and 2 or more HCV-NS5B CD8+ T-cell epitopes. In some cases, the heterologous polypeptide comprises 2, 3, 4, or 5 HCV-NS5B CD4+ T-cell epitopes and 2, 3, 4, or 5 HCV-NS5B CD8+ T-cell epitopes.

In some cases, the heterologous polypeptide comprises a single T-cell epitope. In some cases, the heterologous polypeptide comprises a single HCV-core T-cell epitope. In some cases, the heterologous polypeptide comprises 2 or more T-cell epitopes. In some cases, the heterologous polypeptide comprises 2 or more HCV-core T-cell epitopes. In some cases, the heterologous polypeptide comprises 3 or more HCV-core T-cell epitopes. In some cases, the heterologous polypeptide comprises 4 or more HCV-core T-cell epitopes. In some cases, the heterologous polypeptide comprises a single HCV-core CD4+ T-cell epitope. In some cases, the heterologous polypeptide comprises 2 or more HCV-core CD4+ T-cell epitopes. In some cases, the heterologous polypeptide comprises one or more HCV CD8+ T cell epitopes. In some cases, the heterologous polypeptide comprises a single HCV-core CD8+ T-cell epitope. In some cases, the heterologous polypeptide comprises 2 or more HCV-core CD8+ T-cell epitopes. In some cases, the heterologous polypeptide comprises at least one HCV CD4+ T cell epitope and at least one HCV CD8+ T cell epitope. In some cases, the heterologous polypeptide comprises at least one HCV-core CD4+ T cell epitope and at least one HCV-core CD8+ T cell epitope. In some cases, heterologous polypeptide comprises 2 or more HCV-core CD4+ T-cell epitopes and 2 or more HCV-core CD8+ T-cell epitopes. In some cases, the heterologous polypeptide comprises 2, 3, 4, or 5 HCV-core CD4+ T-cell epitopes and 2, 3, 4, or 5 HCV-core CD8+ T-cell epitopes.

In some cases, the heterologous polypeptide comprises a single T-cell epitope. In some cases, the heterologous polypeptide comprises a single HCV-p7 T-cell epitope. In some cases, the heterologous polypeptide comprises 2 or more T-cell epitopes. In some cases, the heterologous polypeptide comprises 2 or more HCV-p7 T-cell epitopes. In some cases, the heterologous polypeptide comprises 3 or more HCV-p7 T-cell epitopes. In some cases, the heterologous polypeptide comprises 4 or more HCV-p7 T-cell epitopes. In some cases, the heterologous polypeptide comprises a single HCV-p7 CD4+ T-cell epitope. In some cases, the heterologous polypeptide comprises 2 or more HCV-core CD4+ T-cell epitopes. In some cases, the heterologous polypeptide comprises one or more HCV CD8+ T cell epitopes. In some cases, the heterologous polypeptide comprises a single HCV-p7 CD8+ T-cell epitope. In some cases, the heterologous polypeptide comprises 2 or more HCV-p7 CD8+ T-cell epitopes. In some cases, the heterologous polypeptide comprises at least one HCV CD4+ T cell epitope and at least one HCV CD8+ T cell epitope. In some cases, the heterologous polypeptide comprises at least one HCV-p7 CD4+ T cell epitope and at least one HCV-p7 CD8+ T cell epitope. In some cases, heterologous polypeptide comprises 2 or more HCV-p7 CD4+ T-cell epitopes and 2 or more HCV-p7 CD8+ T-cell epitopes. In some cases, the heterologous polypeptide comprises 2, 3, 4, or 5 HCV-p7 CD4+ T-cell epitopes and 2, 3, 4, or 5 HCV-p7 CD8+ T-cell epitopes.

In some cases, the heterologous polypeptide comprises 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, or 63, of the T-cell epitopes set out in FIGS. 13A-13B. In some cases, the heterologous polypeptide comprises from 1 to 3, from 3 to 5, from 5 to 10, from 10 to 15, from 15 to 20, from 20 to 25, or from 25 to 30 of the T-cell epitopes set out in FIGS. 13A-13B. For example, in some cases, the heterologous polypeptide comprises the T-cell epitopes designated NS3-3, NS3-4, and NS3-11 in FIGS. 13A-13B and FIGS. 15A-15N. As another example, in some cases, the heterologous polypeptide comprises the T-cell epitopes designated NS2-1, NS2-2, NS2-3, NS2-7, and NS2-8 in FIGS. 13A-13B and FIGS. 15A-15N. As another example, in some cases, the heterologous polypeptide comprises the T-cell epitopes designated NS3-3, NS3-4, NS3-5, and NS3-11 in FIGS. 13A-13B and FIGS. 15A-15N. As another example, in some cases, the heterologous polypeptide comprises the T-cell epitopes designated NS3-3, NS3-4, NS3-5, NS3-6, NS3-7, NS3-11, NS3-12, and NS3-13 in FIGS. 13A-13B and FIGS. 15A-15N. As another example, in some cases, the heterologous polypeptide comprises the T-cell epitopes designated NS3-3, NS3-4, NS3-5, NS3-6, NS3-7, NS3-10, NS3-11, NS3-12, and NS3-13 in FIGS. 13A-13B and FIGS. 15A-15N. As another example, in some cases, the heterologous polypeptide comprises the T-cell epitopes designated Core-1, Core-2, Core-3, Core-4, Core-5, Core-6, Core-7, Core-8, Core-9, Core-10, Core-11, Core-12, Core-13, Core-14, Core-16, Core-17, Core-18, Core-19, Core-20, Core-21, and Core-22 in FIGS. 13A-13B and FIGS. 15A-15N. As another example, in some cases, the heterologous polypeptide comprises the T-cell epitopes designated NS3-1, NS3-2, NS3-3, NS3-4, NS3-5, NS3-6, NS3-7, NS3-9, NS3-10, NS3-11, NS3-12, and NS3-13 in FIGS. 13A-13B and FIGS. 15A-15N. As another example, in some cases, the heterologous polypeptide comprises the T-cell epitopes designated NS2-1, NS2-2, NS2-3, NS2-4, NS2-5, NS2-6, NS2-7, NS2-8, NS3-1, NS3-2, NS3-3, NS3-4, NS3-5, NS3-6, NS3-7, NS3-9, NS3-10, NS3-11, NS3-12, and NS3-13 in FIGS. 13A-13B and FIGS. 15A-15N. As another example, in some cases, the heterologous polypeptide comprises the T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, and NS4b-10 in FIGS. 13A-13B and FIGS. 15A-15N. As another example, in some cases, the heterologous polypeptide comprises the T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10, NS5a-1, NS5a-2, NS5b-1, and NS5b-2 in FIGS. 13A-13B and FIGS. 15A-15N. In some cases, the T-cell epitopes are contiguous. In some cases, any two T-cell epitopes are separated by linkers (e.g., a linker having a length of from 1 amino acid to about 50 amino acids, e.g., from 1 amino acid to 5 amino acids (aa), from 5 aa to 10 aa, from 10 aa to 15 aa, from 15 aa to 20 aa, from 20 aa to 25 aa, from 25 aa to 30 aa, from 30 aa to 40 aa, or from 40 aa to 50 aa).

In some cases, the heterologous polypeptide comprises at least one HCV CD4+ T cell epitope and at least one HCV CD8+ T cell epitope, where epitopes are conserved among HCV genotypes 1 and 2. In some cases, the heterologous polypeptide comprises at least one HCV CD4+ T cell epitope and at least one HCV CD8+ T cell epitope, where epitopes are conserved among HCV genotypes 1 and 3. In some cases, the heterologous polypeptide comprises at least one HCV CD4+ T cell epitope and at least one HCV CD8+ T cell epitope, where epitopes are conserved among HCV genotypes 1, 2, and 3. In some cases, the heterologous polypeptide comprises at least one HCV CD4+ T cell epitope and at least one HCV CD8+ T cell epitope, where epitopes are conserved among HCV genotypes 1, 2, 3, and 7. In some cases, the heterologous polypeptide comprises at least one HCV CD4+ T cell epitope and at least one HCV CD8+ T cell epitope, where epitopes are conserved among HCV genotypes 1-7.

The heterologous polypeptide can have a length of from about 10 amino acids to about 2000 amino acids; e.g., the heterologous polypeptide can have a length of from 10 amino acids (aa) to 15 aa, from 15 aa to 20 aa, from 20 aa to 25 aa, from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The heterologous polypeptide can have a length of from about 25 amino acids to about 2000 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 500 aa, from 500 aa to 600 aa, from 600 aa to 700 aa, from 700 aa to 800 aa, from 800 aa to 900 aa, from 900 aa to 1000 aa, from 1000 aa to 1100 aa, from 1100 aa to 1200 aa, from 1200 aa to 1300 aa, from 1300 aa to 1400 aa, from 1400 aa to 1500 aa, from 1500 aa to 1600 aa, from 1600 aa to 1700 aa, from 1700 aa to 1800 aa, from 1800 aa to 1900 aa, or from 1900 aa to 2000 aa. The heterologous polypeptide can have a length of from about 25 amino acids to about 3000 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 500 aa, from 500 aa to 600 aa, from 600 aa to 700 aa, from 700 aa to 800 aa, from 800 aa to 900 aa, from 900 aa to 1000 aa, from 1000 aa to 1100 aa, from 1100 aa to 1200 aa, from 1200 aa to 1300 aa, from 1300 aa to 1400 aa, from 1400 aa to 1500 aa, from 1500 aa to 1600 aa, from 1600 aa to 1700 aa, from 1700 aa to 1800 aa, from 1800 aa to 1900 aa, from 1900 aa to 2000 aa, from 2000 aa to 2250 aa, from 2250 aa to 2500 aa, from 2500 aa to 2750 aa, or from 2750 aa to 3000 aa.

The heterologous polypeptide can have a length of from about 25 amino acids to about 800 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The heterologous polypeptide can have a length of from about 25 amino acids to about 400 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, or from 350 aa to 400 aa. The heterologous polypeptide can have a length of 25 amino acids (aa), 26 aa, 27 aa, 28 aa, 29 aa, 30 aa, 31 aa, 32 aa, 33 aa, 34 aa, 35 aa, 36 aa, 37 aa, 38 aa, 39 aa, 40 aa, 41 aa, 42 aa, 43 aa, 44 aa, 45 aa, 46 aa, 47 aa, 48 aa, 49 aa, or 50 aa. The heterologous polypeptide can have a length of from about 100 amino acids (aa) to 800 aa, e.g., from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The heterologous polypeptide can have a length of from 25 aa to 30 aa. The heterologous polypeptide can have a length of from 30 aa to 40 aa. The heterologous polypeptide can have a length of from 40 aa to 50 aa. The heterologous polypeptide can have a length of from 50 aa to 60 aa (e.g., 50 aa, 51 aa, 52, aa, 53 aa, 54 aa, 55 aa, 56 aa, 57 aa, 58 aa, 59 aa, or 60 aa). The heterologous polypeptide can have a length of from 60 aa to 70 aa. The heterologous polypeptide can have a length of from 65 aa to 75 aa (e.g., 65, 66, 67, 68, 69, 70, 71, 72, 7, 74, or 75 aa). The heterologous polypeptide can have a length of 70 aa. The heterologous polypeptide can have a length of from 70 aa to 80 aa. The heterologous polypeptide can have a length of from 80 aa to 90 aa. The heterologous polypeptide can have a length of from 90 aa to 100 aa. The heterologous polypeptide can have a length of from 100 aa to 105 aa (e.g., 100, 101, 102, 103, 104, 105, 106, 107, 108, 109, or 110 aa). The heterologous polypeptide can have a length of 100 aa. The heterologous polypeptide can have a length of from 10 amino acids (aa) to 50 aa; e.g., from 10 aa to 15 aa, from 15 aa to 20 aa, from 20 aa to 25 aa, from 25 aa to 30 aa, from 30 aa to 35 aa, from 35 aa to 40 aa, from 40 aa to 45 aa, or from 45 aa to 50 aa. The heterologous polypeptide can have a length of from 10 amino acids (aa) to 20 aa, e.g., 10, 11, 12, 13, 14, 15, 16, 17, 18, 19, or 20 aa.

HCV NS3 T-Cell Epitopes

In some cases, the heterologous polypeptide present in an E2 variant polypeptide of an E1/E2 heterodimer of the present disclosure includes one or more T-cell epitopes present in an HCV NS3 polypeptide. Examples of T-cell epitopes present in NS3 polypeptides are depicted in FIGS. 15A-15N, FIG. 13B, and FIGS. 14A-14B.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKL (SEQ ID NO: 1). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKL (SEQ ID NO: 1); and has a length of from 25 aa to 35 aa (e.g., 25 aa, 26 aa, 27 aa, 28 aa, 29 aa, 30 aa, 31 aa, 32 aa, 33 aa, 34 aa, or 35 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKL (SEQ ID NO: 1); and has a length of 29 amino acids. Such a polytope can include NS3 T-cell epitopes designated NS3-3, NS3-4, and NS3-11 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKLVALGINAVAYYRGLDVSVIPTSG (SEQ ID NO:2). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKLVALGINAVAYYRGLDVSVIPTSG (SEQ ID NO:2); and has a length of from 45 amino acids to 60 amino acids (e.g., 45 aa, 46 aa, 47 aa, 48 aa, 49 aa, 50 aa, 51 aa, 52 aa, 53 aa, 54 aa, 55 aa, 56 aa, 57 aa, 58 aa, 59 aa, or 60 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKLVALGINAVAYYRGLDVSVIPTSG (SEQ ID NO:2); and has a length of 52 amino acids. Such a polytope can include NS3 T-cell epitopes designated NS3-3, NS3-4, NS3-5, and NS3-11 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: KGGRHLIFCHSKKKCDELAAKLVALGINAVAYYRGLDVSVIPTSGDVVVVATDALMTG FTGDFDSVIDCN (SEQ ID NO:3); and has a length of from 65 amino acids to 80 amino acids (e.g., 65 aa, 66 aa, 67 aa, 68 aa, 69 aa, 70 aa, 71 aa, 72 aa, 73 aa, 74 aa, 75 aa, 76 aa, 77 aa, 78 aa, 79 aa, or 80 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: KGGRHLIFCHSKKKCDELAAKLVALGINAVAYYRGLDVSVIPTSGDVVVVATDALMTG FTGDFDSVIDCN (SEQ ID NO:3); and has a length of 70 amino acids. Such a polytope can include NS3 T-cell epitopes designated NS3-3, NS3-4, NS3-5, NS3-6, NS3-7, NS3-11, NS3-12, and NS3-13 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: VALSTTGEIPFYGKAIPLEVIKGGRHLIFCHSKKKCDELAAKLVALGINAVAYYRGLDVS VIPTSGDVVVVATDALMTGFTGDFDSVIDCNTCVTQTVDF (SEQ ID NO:4); and has a length of from 95 amino acids (aa) to 105 aa (e.g., 95 aa, 96 aa, 97 aa, 98 aa, 99 aa, 100 aa, 101 aa, 102 aa, 103 aa, 104 aa, or 105 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: VALSTTGEIPFYGKAIPLEVIKGGRHLIFCHSKKKCDELAAKLVALGINAVAYYRGLDVS VIPTSGDVVVVATDALMTGFTGDFDSVIDCNTCVTQTVDF (SEQ ID NO:4); and has a length of 100 amino acids. Such a polytope can include NS3 T-cell epitopes designated NS3-3, NS3-4, NS3-5, NS3-6, NS3-7, NS3-10, NS3-11, NS3-12, and NS3-13 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence:

MSTNPKPQRKTKRNTNRRPQDVKFPGGGQIVG-GVYLLPRRGPRLGVRATRKTSERSQP RGRRQPIP-KARRPEGRTWAQPGYPWPLYGNEGCGWAGWLL-SPRGSRPSWGPTDPRRRS RNLGKVIDTLTCGFADLMGYIPLVGAPLGGAARAL-AHGVRVLEDGVNYATGNLPGCSF SIFLLALLSCLTV-PASA (SEQ ID NO:9); and has a length of from 190 amino acids (aa) to 200 aa (e.g., 190 aa, 191 aa, 192 aa, 193 aa, 194 aa, 195 aa, 196 aa, 197 aa, 198 aa, 199 aa, or 200 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQIVG-GVYLLPRRGPRLGVRATRKTSERSQP RGRRQPIP-KARRPEGRTWAQPGYPWPLYGNEGCGWAGWLL-SPRGSRPSWGPTDPRRRS RNLGKVIDTLTCGFADLMGYIPLVGAPLGGAARAL-AHGVRVLEDGVNYATGNLPGCSF SIFLLALLSCLTV-PASA (SEQ ID NO:9); and has a length of 191 amino acids.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGKSTKVPAAYAAQGYKVLVLNPSVAATLG-FGAYMSKAHGIDPNIRTGVRTIT TGSPITYSTYGK-FLADGGCSGGAYDIIICDECHSTDATSILGIGTV-LDQAETAGARLVVLA TATPPGSVTVPHPNIEEVALSTTGEIPFYGKAIPLEVIK-GGRHLIFCHSKKKCDELAAKLV ALGINAVAYYRGLD-VSVIPTSGDVVVVATDALMTGFTGDFDSVIDCN (SEQ ID NO: 10); and has a length of from 215 amino acids (aa) to 235 aa (e.g., 215 aa, 216 aa, 217 11, 218 aa, 219 aa, 220 aa, 221 aa, 222 aa, 223 aa, 224 aa, 225 aa, 226 aa, 227 aa, 228 aa, 229 aa, 230 aa, 231 aa, 232 aa, 233 aa, 234 aa, or 235 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGKSTKVPAAYAAQGYKVLVL-NPSVAATLGFGAYMSKAHGIDPNIRTGVRTIT TGSPI-TYSTYGKFLADGGCSGGAYDIIICDECHSTDATSIL-GIGTVLDQAETAGARLVVLA TATPPGSVTVPHPNIEEVALSTTGEIPFYGKAIPLEVIK-GGRHLIFCHSKKKCDELAAKLV ALGINAVAYYRGLD-VSVIPTSGDVVVVATDALMTGFTGDFDSVIDCN (SEQ ID NO: 10); and has a length of 228 amino acids. Such a polytope can include NS3 T-cell epitopes designated NS3-1, NS3-2, NS3-3, NS3-4, NS3-5, NS3-6, NS3-7, NS3-9, NS3-10, NS3-11, NS3-12, and NS3-13 in FIG. 13B and FIGS. 15A-15N.

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1265-1279 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1309-1323 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1401-1415 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1402-1412 of the amino acid sequence designated "Consensus" in FIGS. 16A-16L, or a corresponding HCV NS3 amino acid sequence of any HCV genotype; and the HCV NS3 T-cell epitope can have a length of from 11 amino acids (aa) to 16 amino acids (e.g., 11 aa, 12 aa, 13 aa, 14 aa, 15 aa, or 16 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1429-1439 of the amino acid sequence designated "Consensus" in FIGS. 16A-16L, or a corresponding HCV NS3 amino acid sequence of any HCV genotype; and the HCV NS3 T-cell epitope can have a length of from 11 amino acids (aa) to 16 amino acids (e.g., 11 aa, 12 aa, 13 aa, 14 aa, 15 aa, or 16 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1450-1464 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1453-1467 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1577-1591 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1306-1314 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1387-1394 of the amino acid sequence designated "Consensus" in FIGS. 16A-16L, or a corresponding HCV NS3 amino acid sequence of any HCV genotype; and the HCV NS3 T-cell epitope can have a length of from 1 amino acids (aa) to 15 amino acids (e.g., 8 aa, 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1405-1413 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1450-1458 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1457-1465 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1610-1618 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

HCV NS2 T-cell Epitopes

In some cases, the heterologous polypeptide present in an E2 variant polypeptide of an E1/E2 heterodimer of the present disclosure includes one or more T-cell epitopes present in an HCV NS2 polypeptide. Examples of T-cell epitopes present in NS2 polypeptides are depicted in FIGS. 15A-15N, and FIG. 13A.

For example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 955-974 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 975-994 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 985-1004 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1015-1034 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1035-1054 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 924-933 of the amino acid sequence designated "Consensus" in FIGS. 16A-16L, or a corresponding HCV NS2 amino acid sequence of any HCV genotype; and the NS2 T cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 961-970 of the amino acid sequence designated "Consensus" in FIGS. 16A-16L, or a corresponding HCV NS2 amino acid sequence of any HCV genotype; and the NS2 T cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 989-997 of the amino acid sequence designated "Consensus" in FIGS. 16A-16L, or a corresponding HCV NS2 amino acid sequence of any HCV genotype; and the NS2 T cell epitope can have a length of from 9 amino acids (aa) to 15 amino acids (e.g., 9 aa, 10 aa, 11 aa, 12 aa, 13 aa, 14 aa, or 15 aa).

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 50 aa (e.g., from 10 aa to 25 aa, or from 25 aa to 50 aa) of amino acids 955-1004 of the amino acid sequence designated "Consensus" in FIGS. 16A-16L, or a corresponding HCV NS2 amino acid sequence of any HCV genotype; and has a length of from 10 amino acids (aa) to 25 aa, or from 25 aa to 50 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 955-1004 of the amino acid sequence designated "Consensus" in FIGS. 16A-16L, or a corresponding HCV NS2 amino acid sequence of any HCV genotype; and has a length of about 50 amino acids.

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 553 aa (e.g., from 10 aa to 25 aa, from 25 aa to 50 aa, from 50 aa to 100 aa, from 100 aa to 200 aa, from 200 aa to 300 aa, from 300 aa to 400 aa, from 400 aa to 500 aa, or from 500 aa to 553 aa) of amino acids 917-1469 of the amino acid sequence designated "Consensus" in FIGS. 16A-16L, or a corresponding HCV NS2 and NS3 amino acid sequence of any HCV genotype; and has a length of from 10 amino acids (aa) to 25 aa, from 25 aa to 50 aa, from 50 aa to 100 aa, from 100 aa to 200 aa, from 200 aa to 300 aa, from 300 aa to 400 aa, from 400 aa to 500 aa, or from 500 aa to 553 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 917-1469 of the amino acid sequence designated "Consensus" in FIGS. 16A-16L, or a corresponding HCV NS2 and NS3 amino acid sequence of any HCV genotype; and has a length of about 553 amino acids.

The heterologous polypeptide can comprise an amino acid sequence having at least about 20%, at least about 25%, at least about 30%, at least about 35%, at least about 40%, at least about 45%, at least about 50%, at least about 60%, at least about 0%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRDWAHNGLRDLAVAVEPV-VFSQMETKLITWGADT (SEQ ID NO: 11). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRDWAHNGLRDLAVAVEPV-VFSQMETKLITWGADT (SEQ ID NO:11); and has a length of from 50 amino acids to 60 amino acids (e.g., 50 aa, 51 aa, 52 aa, 53 aa, 54 aa, 55 aa, 56 aa, 57 aa, 58 aa, 59 aa, or 60 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRD-WAHNGLRDLAVAVEPVVFSQMETKLITWGADT (SEQ ID NO: 11); and has a length of 50 amino acids. Such a polytope can include NS2 T-cell epitopes designated NS2-1, NS2-2, NS2-3, NS2-7, and NS2-8 in FIG. 13A and FIGS. 15A-15N.

HCV NS4A T-cell Epitopes

In some cases, the heterologous polypeptide present in an E2 variant polypeptide of an E1/E2 heterodimer of the present disclosure includes one or more T-cell epitopes present in an HCV NS4A polypeptide. Examples of T-cell epitopes present in NS4A polypeptides are depicted in FIGS. 15A-15N and FIG. 13B.

The heterologous polypeptide can comprise an NS4A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1683-1692 of the amino acid sequence designated "Consensus" in FIGS. 16A-16L, or a corresponding HCV NS4A amino acid sequence of any HCV genotype; and the NS4A T-cell epitope can have a length of from 10 amino acids (aa) to 15 amino acids (e.g., 10 aa, 11 aa, 12 aa, 13 aa, 14 aa, or 15 aa).

HCV NS4B T-cell Epitopes

In some cases, the heterologous polypeptide present in an E2 variant polypeptide of an E1/E2 heterodimer of the present disclosure includes one or more T-cell epitopes present in an HCV NS4B polypeptide. Examples of T-cell epitopes present in NS4B polypeptides are depicted in FIGS. 15A-15N and FIG. 13B.

As one example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1790-1801 of the amino acid sequence designated "Consensus" in FIGS. 16A-16L, or a corresponding HCV NS4B amino acid sequence of any HCV genotype; and the NS4B T-cell epitope can have a length of from 12 amino acids (aa) to 20 amino acids (e.g., 12 aa, 13 aa, 14 aa, 15 aa, 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1792-1802 of the amino acid sequence designated "Consensus" in FIGS. 16A-16L, or a corresponding HCV NS4B amino acid sequence of any HCV genotype; and the NS4B T-cell epitope can have a length of from 11 amino acids (aa) to 20 amino acids (e.g., 11 aa, 12 aa, 13 aa, 14 aa, 15 aa, 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1898-1905 of the amino acid sequence designated "Consensus" in FIGS. 16A-16L, or a corresponding HCV NS4B amino acid sequence of any HCV genotype; and the NS4B T-cell epitope can have a length of from 8 amino acids (aa) to 15 amino acids (e.g., 8 aa, 9 aa, 10 aa, 11 aa, 12 aa, 13 aa, 14 aa, or 15 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1921-1935 of the amino acid sequence designated "Consensus" in FIGS. 16A-16L, or a corresponding HCV NS4B amino acid sequence of any HCV genotype; and the NS4B T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1922-1941 of the amino acid sequence designated "Consensus" in FIGS. 16A-16L, or a corresponding HCV NS4B amino acid sequence of any HCV genotype; and the NS4B T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1928-1947 of the amino acid sequence designated "Consensus" in FIGS. 16A-16L, or a corresponding HCV NS4B amino acid sequence of any HCV genotype; and the NS4B T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1868-1876 of the amino acid sequence designated "Consensus" in FIGS. 16A-16L, or a corresponding HCV NS4B amino acid sequence of any HCV genotype; and the NS4B T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1927-1942 of the amino acid sequence designated "Consensus" in FIGS. 16A-16L, or a corresponding HCV NS4B amino acid sequence of any HCV genotype; and the NS4B T-cell epitope can have a length of from 16 amino acids (aa) to 20 amino acids (e.g., 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1932-1940 of the amino acid sequence designated "Consensus" in FIGS. 16A-16L, or a corresponding HCV NS4B amino acid sequence of any HCV genotype; and the NS4B T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1948-1962 of the amino acid sequence designated "Consensus" in FIGS. 16A-16L, or a corresponding HCV NS4B amino acid sequence of any HCV genotype; and the NS4B T-cell epitope can have a length of from 15 amino acids (aa) to 20 amino acids (e.g., 15 aa, 16 aa, 17 aa, 18 aa, 19 aa, or 20 aa).

HCV NS5A T-cell Epitopes

In some cases, the heterologous polypeptide present in an E2 variant polypeptide of an E1/E2 heterodimer of the present disclosure includes one or more T-cell epitopes present in an HCV NS5A polypeptide. Examples of T-cell epitopes present in NS5A polypeptides are depicted in FIGS. 15A-15N and FIG. 13B.

As one example, the heterologous polypeptide can comprise an NS5A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2218-2232 of the amino acid sequence designated "Consensus" in FIGS. 16A-16L, or a corresponding HCV NS5A amino acid sequence of any HCV genotype; and the NS5A T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an NS5A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2309-2317 of the amino acid sequence designated "Consensus" in FIGS. 16A-16L, or a corresponding HCV NS5A amino acid sequence of any HCV genotype; and the NS5A T-cell epitope can have a length of from 9 amino acids (aa) to 15 amino acids (e.g., 9 aa, 10 aa, 11 aa, 12 aa, 13 aa, 14 aa, or 15 aa).

HCV NS5B T-cell Epitopes

In some cases, the heterologous polypeptide present in an E2 variant polypeptide of an E1/E2 heterodimer of the present disclosure includes one or more T-cell epitopes present in an HCV NS5B polypeptide. Examples of T-cell epitopes present in NS5B polypeptides are depicted in FIGS. 15A-15N and FIG. 13B.

As one example, the heterologous polypeptide can comprise an NS5B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2847-2851 of the amino acid sequence designated "Consensus" in FIGS. 16A-16L, or a corresponding HCV NS5B amino acid sequence of any HCV genotype; and the NS5B T-cell epitope can have a length of from 5 amino acids (aa) to 10 amino acids (e.g., 5 aa, 6 aa, 7 aa, 8 aa, 9 aa, or 10 aa).

As another example, the heterologous polypeptide can comprise an NS5B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2602-2610 of the amino acid sequence designated "Consensus" in FIGS. 16A-16L, or a corresponding HCV NS5B amino acid sequence of any HCV genotype; and the NS5B T-cell epitope can have a length of from 9 amino acids (aa) to 15 amino acids (e.g., 9 aa, 10 aa, 11 aa, 12 aa, 13 aa, 14 aa, or 15 aa).

HCV Core T-cell Epitopes

In some cases, the heterologous polypeptide present in an E2 variant polypeptide of an E1/E2 heterodimer of the present disclosure includes one or more T-cell epitopes present in an HCV core polypeptide. Examples of T-cell epitopes present in HCV Core polypeptides are depicted in FIGS. 15A-15N and FIG. 13A.

As one example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1-20 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 11-30 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 21-40 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 39-63 of the amino acid sequence designated "Consensus" in FIGS. 16A-16L, or a corresponding HCV core amino acid sequence of any HCV genotype; and the HCV core T-cell epitope can have a length of from 23 amino acids (aa) to 28 amino acids (e.g., 23 aa, 24 aa, 25 aa, 26 aa, 27 aa, or 28 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 47-70 of the amino acid sequence designated "Consensus" in FIGS. 16A-16L, or a corresponding HCV core amino acid sequence of any HCV genotype; and the HCV core T-cell epitope can have a length of from 24 amino acids (aa) to 29 amino acids (e.g., 24 aa, 25 aa, 26 aa, 27 aa, 28 aa, or 29 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 61-80 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 71-90 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 81-100 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 91-110 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 101-115 of the amino acid sequence designated "Consensus" in FIGS. 16A-16L, or a corresponding HCV core amino acid sequence of any HCV genotype; and the HCV core T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 111-130 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 125-139 of the amino acid sequence designated "Consensus" in FIGS. 16A-16L, or a corresponding HCV core amino acid sequence of any HCV genotype; and the HCV core T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 131-150 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 151-170 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 161-180 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 35-44 of the amino acid sequence designated "Consensus" in FIGS. 16A-16L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 43-51 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 51-59 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 129-137 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 131-140 of the amino acid sequence designated "Consensus" in FIGS. 16A-16L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 150-158 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 154-162 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 168-176 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 177-187 of the amino acid sequence designated "Consensus" in FIGS. 16A-16L, or a corresponding HCV core amino acid sequence of any HCV genotype; and the HCV core T-cell epitope can have a length of from 11 amino acids (aa) to 16 amino acids (e.g., 11 aa, 12 aa, 13 aa, 14 aa, 15 aa, or 16 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 178-187 of the amino acid sequence designated "Consensus" in FIGS. 16A-16L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 191 aa (e.g., from 10 aa to 25 aa, from 25 aa to 50 aa, from 50 aa to 75 aa, from 75 aa to 100 aa, from 100 aa to 150 aa, or from 150 aa to 191 aa) of amino acids 1-191 of the amino acid sequence designated "Consensus" in FIGS. 16A-16L, or a corresponding HCV core amino acid sequence of any HCV genotype; and has a length of from 10 amino acids (aa) to 25 aa, from 25 aa to 50 aa, from 50 aa to 100 aa, or from 100 aa to 150 aa, or from 150 aa to 191 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1-191 of the amino acid sequence designated "Consensus" in FIGS. 16A-16L, or a corresponding HCV core amino acid sequence of any HCV genotype; and has a length of about 191 amino acids.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQIVG-GVYLLPRRGPRLGVRATRKTS ERSQPRGRRQPIP-KARRPEGRTWAQPGYPWPLYGNEGCGWAGWLL-SPRGSRPS WGPTDPRRRSRNLGKVIDTLTCGFADLMGYIPLVGA-PLGGAARALAHGVRVLE DGVNYATGNLPG (SEQ ID NO:63); and has a length of from 171 amino acids (aa) to 180 aa (e.g., 171 aa, 172 aa, 173 aa, 174 aa, 175 aa, 176 aa, 177 aa, 178 aa, 179 aa, or 180 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPK-PQRKTKRNTNRRPQDVKFPGGGQIVGGVYLLPRRG-PRLGVRATRKTS ERSQPRGRRQPIPKARRPEGRT-WAQPGYPWPLYGNEGCGWAGWLLSPRGSRPS WGPTDPRRRSRNLGKVIDTLTCGFADLMGYIPLVGA-PLGGAARALAHGVRVLE DGVNYATGNLPG (SEQ ID NO:63); and has a length of 171 amino acids. Such a polytope can include core T-cell epitopes designated Core-1, Core-2, Core-3, Core-4, Core-5, Core-6, Core-7, Core-8, Core-9, Core-10, Core-11, Core-12, Core-13, Core-14, Core-16, Core-17, Core-18, Core-19, Core-20, Core-21, Core-22 in FIG. 13A and FIGS. 15A-15N.

HCV p7 T-cell Epitopes

In some cases, the heterologous polypeptide present in an E2 variant polypeptide of an E1/E2 heterodimer of the present disclosure includes one or more T-cell epitopes present in an HCV p7 polypeptide. Examples of T-cell epitopes present in HCV p7 polypeptides are depicted in FIGS. 15A-15N or FIG. 13A.

As another example, the heterologous polypeptide can comprise an HCV p7 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 803-811 of the amino acid sequence designated "Consensus" in FIGS. 16A-16L, or a corresponding HCV p7 amino acid sequence of any HCV genotype; and the HCV p7 T-cell epitope can have a length of from 9 amino acids (aa) to 15 amino acids (e.g., 9 aa, 10 aa, 11 aa, 12 aa, 13 aa, 14 aa, or 15 aa).

Polytopes Including HCV T-cell Epitopes from more than One HCV Polypeptide other than E1 and E2

As noted above, a heterologous polypeptide can include T-cell epitopes from more than one HCV polypeptide other than E1 and E2.

Figure 15E:
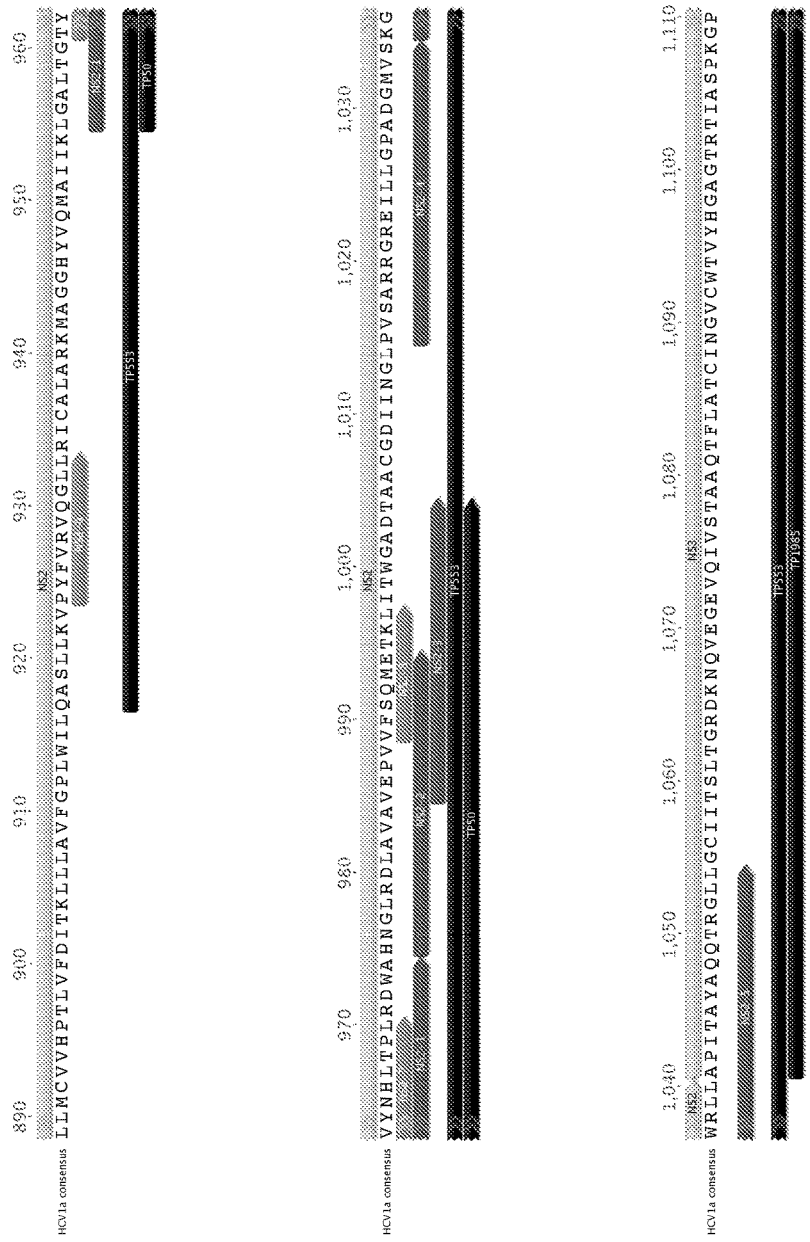
Figure 15G:
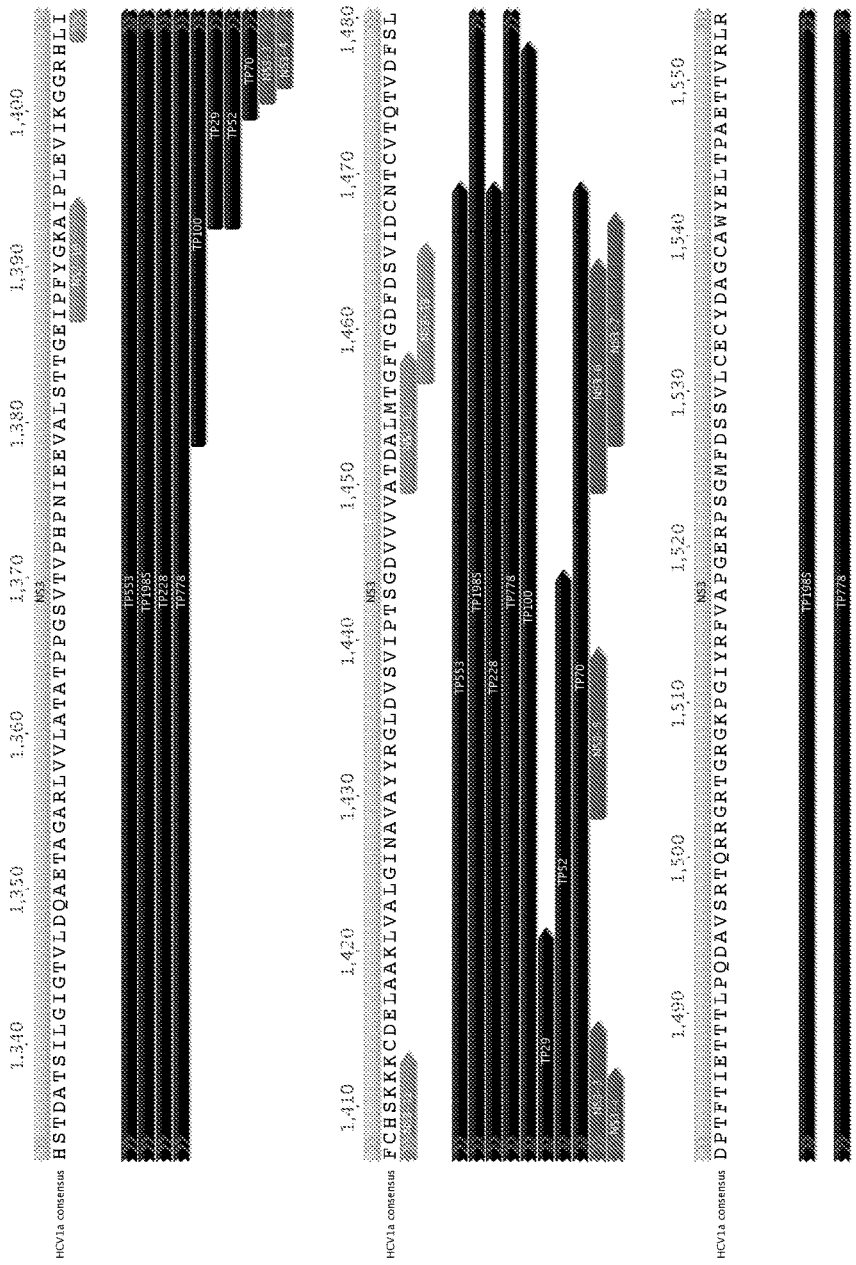
Figure 15H:
Figure 15I:
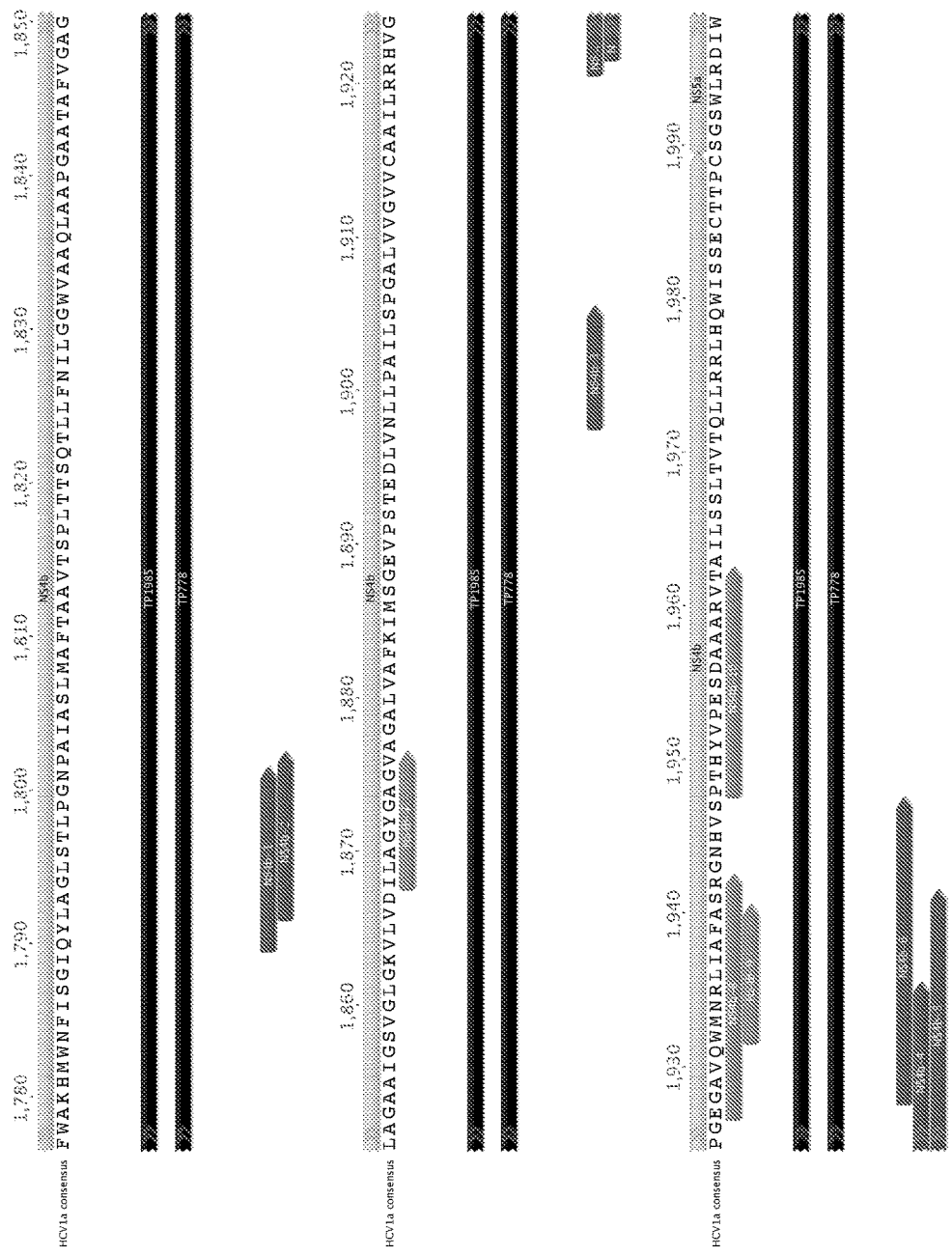
Figure 15K:
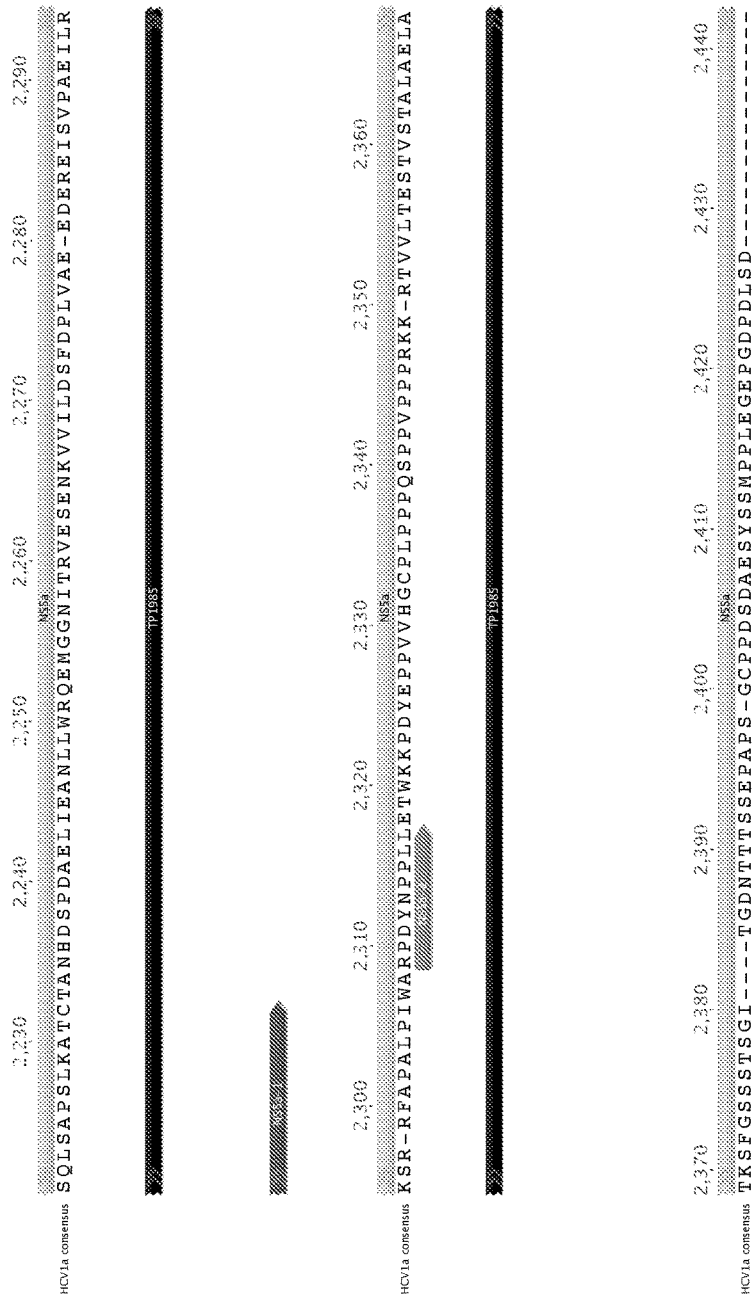
Figure 15M:
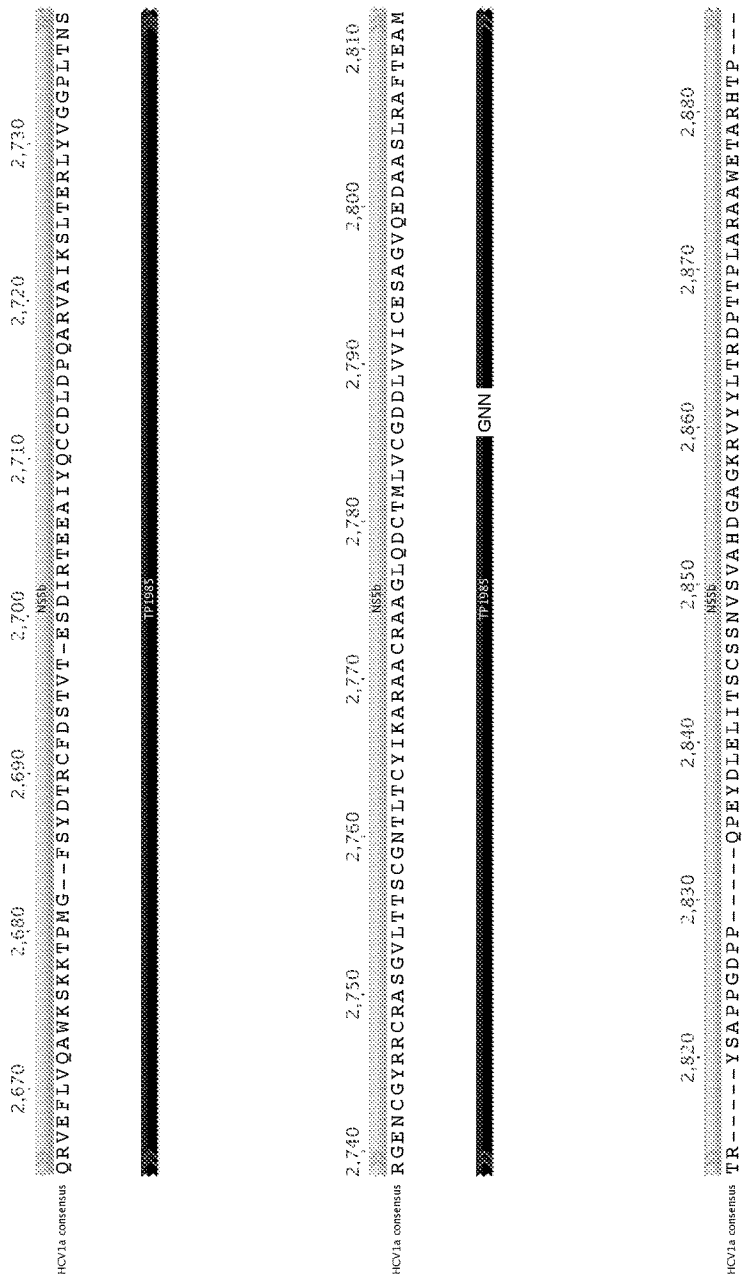

As one example, a heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: QASLLKVPYFVRVQGLLRICALARKMAG-GHYVQMAIIKLGALTGTYVYNALTP LRDWAHNGL-RDLAVAVEPVVFSQMETKLITWGADTAACGDI-INGLPVSARRGR EILLGPADGMVSKGWRLLAPITAYAQQTRGLLGCIIT-SLTGRDKNQVEGEVQIVS TAAQTFLATCINGVCWT-VYHGAGTRTIASPKGPVIQMYTNVDQDLVGW-PAPQG ARSLTPCTCGSSDLYLVTRHADVIPVRRRGDSRGSLL-SPRPISYLKGSAGGPLLCP AGHAVGIFRAAVCTRG-VAKAVDFIPVENLETTMRSPVFTDNSSPPAVPQSFQVA HLHAPTGSGKSTKVPAAYAAQGYKVLVLNPSVAATL-GFGAYMSKAHGIDPNIR TGVRTITTGSPITYSTYGK-FLADGGCSGGAYDIIICDECHSTDATSILGIGTVLDQA ETAGARLVVLATATPPGSVTVPHPNIEEVALSTTGEIP-FYGKAIPLEVIKGGRHLIF CHSKKKCDELAAKLVAL-GINAVAYYRGLDVSVIPTSGDVVVVATDALMTGFTG DFDSVIDCN (SEQ ID NO: 12); and has a length of from 550 amino acids (aa) to 560 aa (e.g., 550 aa, 551 aa, 552 aa, 553 aa, 554 aa, 555 aa, 556 aa, 557 aa, 558 aa, 559 aa, or 560 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: QASLLKVPYFVRVQGLLRICALARKMAG-GHYVQMAIIKLGALTGTYVYNALTP LRDWAHNGL-RDLAVAVEPVVFSQMETKLITWGADTAACGDI-INGLPVSARRGR EILLGPADGMVSKGWRLLAPITAYAQQTRGLLGCIIT-SLTGRDKNQVEGEVQIVS TAAQTFLATCINGVCWT-VYHGAGTRTIASPKGPVIQMYTNVDQDLVGW-PAPQG ARSLTPCTCGSSDLYLVTRHADVIPVRRRGDSRGSLL-SPRPISYLKGSAGGPLLCP AGHAVGIFRAAVCTRG- VAKAVDFIPVENLETTMRSPVFTDNSSPPAVPQSFQVA HLHAPTGSGKSTKVPAAYAAQGYKVLVLNPSVAATLGFGAYMSKAHGIDPNIR TGVRTITTGSPITYSTYGKFLADGGCSGGAYDIIICDECHSTDATSILGIGTVLDQA ETAGARLVVLATATPPGSVTVPHPNIEEVALSTTGEIPFYGKAIPLEVIKGGRHLIF CHSKKKCDELAAKLVALGINAVAYYRGLDVSVIPTSGDVVVVATDALMTGFTG DFDSVIDCN (SEQ ID NO: 12); and has a length of 553 amino acids. Such a polytope can include T-cell epitopes designated NS2-1, NS2-2, NS2-3, NS2-4, NS2-5, NS2-6, NS2-7, NS2-8, NS3-1, NS3-2, NS3-3, NS3-4, NS3-5, NS3-6, NS3-7, NS3-9, NS3-10, NS3-11, NS3-12, and NS3-13 in FIGS. 13A-13B and FIGS. 15A-15N. This polytope is also referred to as "TP553" (FIGS. 14A-14D). In order to prevent self cleavage of the TP553 polytope (amino acids 917-1469) (FIGS. 15E-G) at the NS2-NS3 junction that is mediated by the catalytic domain of the NS2 protease (amino acids 917-1040), the histidine at position 966 (H966), a critical residue for NS2 protease activity, is mutated to alanine (H966A) (FIG. 15E).

As another example, the heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 778 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 450 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 778 aa) the following amino acid sequence: LHAPTGSGKSTKVPAAYAAQGYKVLVLNPSVAATLGFGAYMSKAHGIDPNIRTGVRTIT TGSPITYSTYGKFLADGGCSGGAYDIIICDECHSTDATSILGIGTVLDQAETAGARLVVLA TATPPGSVTVPHPNIEEVALSTTGEIPFYGKAIPLEVIKGGRHLIFCHSKKKCDELAAKLV ALGINAVAYYRGLDVSVIPTSGDVVVVATDALMTGFTGDFDSVIDCNTCVTQTVDFSLD PTFTIETTTLPQDAVSRTQRRGRTGRGKPGIYRFVAPGERPSGMFDSSVLCECYDAGCA WYELTPAETTVRLRAYMNTPGLPVCQDHLEFWEGVFTGLTHIDAHFLSQTKQSGENLP YLVAYQATVCARAQAPPPSWDQMWKCLIRLKPTLHGPTPLLYRLGAVQNEVTLTHPIT KYIMTCMSADLEVVTSTWVLVGGVLAALAAYCLSTGCVVIVGRIVLSGKPAIIPDREVL YREFDEMEECSQHLPYIEQGMMLAEQFKQKALGLLQTASRQAEVIAPAVQTNWQKLEA FWAKHMWNFISGIQYLAGLSTLPGNPAIASLMAFTAAVTSPLTTSQTLLFNILGGWVAA QLAAPGAATAFVGAGLAGAAIGSVGLGKVLVDILAGYGAGVAGALVAFKIMSGEVPST EDLVNLLPAILSPGALVVGVVCAAILRRHVGPGEGAVQWMNRLIAFASRGNHVSPTHY VPESDAAARVTAILSSLTVTQLLRRLHQWISSECTTPCSGSWLRDIWDWICEVLSDFKTW LKAKLMPQLPG (SEQ ID NO:64). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 778 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 450 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 778 aa) of the following amino acid sequence: LHAPTGSGKSTKVPAAYAAQGYKVLVLNPSVAATLGFGAYMSKAHGIDPNIRTGVRTIT TGSPITYSTYGKFLADGGCSGGAYDIIICDECHSTDATSILGIGTVLDQAETAGARLVVLA TATPPGSVTVPHPNIEEVALSTTGEIPFYGKAIPLEVIKGGRHLIFCHSKKKCDELAAKLV ALGINAVAYYRGLDVSVIPTSGDVVVVATDALMTGFTGDFDSVIDCNTCVTQTVDFSLD PTFTIETTTLPQDAVSRTQRRGRTGRGKPGIYRFVAPGERPSGMFDSSVLCECYDAGCA WYELTPAETTVRLRAYMNTPGLPVCQDHLEFWEGVFTGLTHIDAHFLSQTKQSGENLP YLVAYQATVCARAQAPPPSWDQMWKCLIRLKPTLHGPTPLLYRLGAVQNEVTLTHPIT KYIMTCMSADLEVVTSTWVLVGGVLAALAAYCLSTGCVVIVGRIVLSGKPAIIPDREVL YREFDEMEECSQHLPYIEQGMMLAEQFKQKALGLLQTASRQAEVIAPAVQTNWQKLEA FWAKHMWNFISGIQYLAGLSTLPGNPAIASLMAFTAAVTSPLTTSQTLLFNILGGWVAA QLAAPGAATAFVGAGLAGAAIGSVGLGKVLVDILAGYGAGVAGALVAFKIMSGEVPST EDLVNLLPAILSPGALVVGVVCAAILRRHVGPGEGAVQWMNRLIAFASRGNHVSPTHY VPESDAAARVTAILSSLTVTQLLRRLHQWISSECTTPCSGSWLRDIWDWICEVLSDFKTW LKAKLMPQLPG (SEQ ID NO:64); and has a length of from 25 amino acids (aa) to 50 aa, from 50 aa to 100 aa, from 100 aa to 200 aa, from 200 aa to 300 aa, from 300 aa to 400 aa, from 400 aa to 500 aa, from 500 aa to 600 aa, from 600 aa to 700 aa, or from 700 aa to 778 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGKSTKVPAAYAAQGYKVLVLNPSVAATLGFGAYMSKAHGIDPNIRTGVRTIT TGSPITYSTYGKFLADGGCSGGAYDIIICDECHSTDATSILGIGTVLDQAETAGAR LVVLA TATPPGSVTVPHPNIEEVALSTTGEIPFYGKAIPLEVIKGGRHLIFCHSKKKCDELAAKLV ALGINAVAYYRGLDVSVIPTSGDVVVVATDALMTGFTGDFDSVIDCNTCVTQTVDFSLD PTFTIETTTLPQDAVSRTQRRGRTGRGKPGIYRFVAPGERPSGMFDSSVLCECYDAGCA WYELTPAETTVRLRAYMNTPGLPVCQDHLEFWEGVFTGLTHIDAHFLSQTKQSGENLP YLVAYQATVCARAQAPPPSWDQMWKCLIRLKPTLHGPTPLLYRLGAVQNEVTLTHPIT KYIMTCMSADLEVVTSTWVLVGGVLAALAAYCLSTGCVVIVGRIVLSGKPAIIPDREVL YREFDEMEECSQHLPYIEQGMMLAEQFKQKALGLLQTASRQAEVIAPAVQTNWQKLEA FWAKHMWN- FISGIQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPST EDLVNLLPAILSPGALVVGVVCAAILRRHVGPGEGAVQWMNRLIAFASRGNHVSPTHY VPESDAAARVTAILSSLTVTQLLRRLHQWISSECTTPCSGSWLRDIWDWICEVLSDFKTW LKAKLMPQLPG (SEQ ID NO:64); and has a length of 778 amino acids. Such a polytope can include T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS2-14, NS4a-1, NS4b-1, NS4b-2, NS4b-3, NS4b-4, NS4b-5, NS4b-6, NS4b-7, NS4b-8, NS4b-9, and NS4b-10 in FIG. 13B and FIGS. 15A-15N.

As another example, the heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 1985 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 500 aa, from 500 aa to 750 aa, from 750 aa to 1000 aa, from 1000 aa to 1500 aa, or from 1500 aa to 1985 aa) of the following amino acid sequence:

```
                                          (SEQ ID NO: 13)
APITAYAQQTRGLLGCIITSLTGRDKNQVEGEVQIVSTAAQTFLATCING

VCWTVYHGAGTRTIASPKGPVIQMYTNVDQDLVGWPAPQGARSLTPCTCG

SSDLYLVTRHADVIPVRRRGDSRGSLLSPRPISYLKGSAGGPLLCPAGHA

VGIFRAAVCTRGVAKAVDFIPVENLETTMRSPVFTDNSSPPAVPQSFQVA

HLHAPTGSGKSTKVPAAYAAQGYKVLVLNPSVAATLGFGAYMSKAHGIDP

NIRTGVRTITTGSPITYSTYGKFLADGGCSGGAYDIIICDECHSTDATSI

LGIGTVLDQAETAGARLVVLATATPPGSVTVPHPNIEEVALSTTGEIPFY

GKAIPLEVIKGGRHLIFCHSKKKCDELAAKLVALGINAVAYYRGLDVSVI

PTSGDVVVVATDALMTGFTGDFDSVIDCNTCVTQTVDFSLDPTFTIETTT

LPQDAVSRTQRRGRTGRGKPGIYRFVAPGERPSGMFDSSVLCECYDAGCA

WYELTPAETTVRLRAYMNTPGLPVCQDHLEFWEGVFTGLTHIDAHFLSQT

KQSGENLPYLVAYQATVCARAQAPPPSWDQMWKCLIRLKPTLHGPTPLLY

RLGAVQNEVTLTHPITKYIMTCMSADLEVVTSTWVLVGGVLAALAAYCLS

TGCVVIVGRIVLSGKPAIIPDREVLYREFDEMEECSQHLPYIEQGMMLAE

QFKQKALGLLQTASRQAEVIAPAVQTNWQKLEAFWAKHMWNFISGIQYLA

GLSTLPGNPAIASLMAFTAAVTSPLTTSQTLLFNILGGWVAAQLAAPGAA

TAFVGAGLAGAAIGSVGLGKVLVDILAGYGAGVAGALVAFKIMSGEVPST

EDLVNLLPAILSPGALVVGVVCAAILRRHVGPGEGAVQWMNRLIAFASRG

NHVSPTHYVPESDAAARVTAILSSLTVTQLLRRLHQWISSECTTPCSGSW

LRDIWDWICEVLSDFKTWLKAKLMPQLPGIPFVSCQRGYRGVWRGDGIMH

TRCHCGAEITGHVKNGTMRIVGPRTCRNMWSGTFPINAYTTGPCTPLPAP
```

-continued
```
NYTFALWRVSAEEYVEIRQVGDFHYVTGMTTDNLKCPCQVPSPEFFTELD

GVRLHRFAPPCKPLLREEVSFRVGLHEYPVGSQLPCEPEPDVAVLTSMLT

DPSHITAEAAGRRLARGSPPSVASSSASQLSAPSLKATCTANHDSPDAEL

IEANLLWRQEMGGNITRVESENKVVILDSFDPLVAEEDEREISVPAEILR

KSRRFAPALPIWARPDYNPPLLETWKKPDYEPPVVHGCPLPPPQSPPVPP

PRKKRTVVLTESTVSTALAELATKSFGSSSTSGITGDNTTTSSEPAPSGC

PPDSDAESYSSMPPLEGEPGDPDLSDGSWSTVSSEADTEDVVCCSMSYSW

TGALVTPCAAEEQKLPINALSNSLLRHHNLVYSTTSRSACQRQKKVTFDR

LQVLDSHYQDVLKEVKAAASKVKANLLSVEEACSLTPPHSAKSKFGYGAK

DVRCHARKAVNHINSVWKDLLEDSVTPIDTTIMAKNEVFCVQPEKGGRKP

ARLIVFPDLGVRVCEKMALYDVVSKLPLAVMGSSYGFQYSPGQRVEFLVQ

AWKSKKTPMGFSYDTRCFDSTVTESDIRTEEAIYQCCDLDPQARVAIKSL

TERLYVGGPLTNSRGENCGYRRCRASGVLTTSCGNTLTCYIKARAACRAA

GLQDCTMLVCGNNLVVICESAGVQEDAASLRAFTEAMTRYSAPPGDPPQP

EYDLELITSCSSNVSVAHDGAGKRVYYLTRDPTTPLARAAWETARHTPVN

SWLGNIIMFAPTLWARMILMTHFFSVLIARDQLEQALDCEIYGACYSIEP

LDLPPIIQRLHGLSAFSLHSYSPGEINRVAACLRKLGVPPLRAWRHRARS

VRARLLSRGGRAAICGKYLFNWAVRTKLKLTPIAAAGQLDLSGWFTAGYS

GGDIYHSVSHARPRWFWFCLLLLAAGVGIYLLPNR.
```

In some cases, the heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: APITAYAQQTRGLLGCIITSLTGRDKNQVEGEVQIVSTAAQTFLATCINGVCWTV YHGAGTRTIASPKGPVIQMYTNVDQDLVGWPAPQGARSLTPCTCGSSDLYLVT RHADVIPVRRRGDSRGSLLSPRPISYLKGS AGGPLLCPAGHAVGIFRAAVCTRGV AKAVDFIPVENLETTMRSPVFTDNSSPPAVPQSFQVAHLHAPTGSGKSTKVPAA YAAQGYKVLVLNPSVAATLGFGAYMSKAHGIDPNIRTGVRTITTGSPITYSTYG KFLADGGCSGGAYDIIICDECHSTDATSILGIGTVLDQAETAGARLVVLATATPP GSVTVPHPNIEEVALSTTGEIPFYGKAIPLEVIKGGRHLIFCHSKKKCDELAAKLV ALGINAVAYYRGLDVSVIPTSGDVVVVATDALMTGFTGDFDSVIDCNTCVTQT VDFSLDPTFTIETTTLPQDAVSRTQRRGRTGRGKPGIYRFVAPGERPSGMFDSSV LCECYDAGCAWYELTPAETTVRLRAYMNTPGLPVCQDHLEFWEGVFTGLTHID AHFLSQTKQSGENLPYLVAYQATVCARAQAPPPSWDQMWKCLIRLKPTLHGPT PLLYRLGAVQNEVTLTHPITKYIMTCMSADLEVVTSTWVLVGGVLAALAAYCL STGCVVIVGRIVLSGKPAIIPDREVLYREFDEMEECSQHLPYIEQGMMLAEQFKQ KALGLLQTASRQAEVIAPAVQTNWQKLEAFWAKHMWNFISGIQYLAGLSTLPG NPAIASLMAFTAAVTSPLTTSQTLLFNILGGWVAAQLAAPGAATAFVGAGLAGA AIGSVGLGKVLVDILAGYGAGVAGALVAFKIMS- GEVPSTEDLVNLLPAILSPGAL VVGVVCAAILR-
RHVGPGEGAVQWMNRLIAFASRGNHVSPTHYVPES-
DAAARV
TAILSSLTVTQLLRRLHQWISSECTTPCSGSWLRDI-
WDWICEVLSDFKTWLKAKL MPQLPGIPFVSCQR-
GYRGVWRGDGIMHTRCHCGAEITGHVKNGTM-
RIVGPRTC
RNMWSGTFPINAYTTGPCTPLPAPNYTFALWRV-
SAEEYVEIRQVGDFHYVTGM TTDNLKCPCQVPSP-
EFFTELDGVRLHRFAPPCKPLLREEVSFRVGL-
HEYPVGSQL
PCEPEPDVAVLTSMLTDPSHITAEAAGRRLARGSPPS-
VASSSASQLSAPSLKATCT ANHDSPDAELIEANLL-
WRQEMGGNITRVESENKVVILDSFDPLVAEEDER-
EISVP
AEILRKSRRFAPALPIWARPDYNPPLLETWKKPDYEP-
PVVHGCPLPPPQSPPVPPP RKKRTVVLTESTVSTA-
LAELATKSFGSSSTSGITGDNTTTSSEPAPSGCPPDS-
DAE
SYSSMPPLEGEPGDPDLSDGSWSTVSSEADTEDV-
VCCSMSYSWTGALVTPCAAE EQKLPINALSNSLL-
RHHNLVYSTTSRSACQRQKKVTFDRLQVLDSHYQD-
VLKEV
KAAASKVKANLLSVEEACSLTPPHSAKSKFGY-
GAKDVRCHARKAVNHINSVW KDLLEDSVTPIDTTI-
MAKNEVFCVQPEKGGRKPARLIVFPDLGVRVCEK-
MALYD
VVSKLPLAVMGSSYGFQYSPGQRVEFLVQAWKSKK-
TPMGFSYDTRCFDSTVTE SDIRTEEAIYQCCDLD-
PQARVAIKSLTERLYVGGPLTNSRGENCGYRRCRAS-
GVL TTSCGNTLTCYIKARAACRAAGLQDCTMLVCG
NNLVVICESAGVQEDAASLRA FTEAMTRYSAPPGDP-
PQPEYDLELITSCSSNVSVAHDGAGKRVYYLTRDPTT-
PLA RAAWETARHTPVNSWLGNIIMFAPTLWARM-
ILMTHFFSVLIARDQLEQALDCEI
YGACYSIEPLDLPPIIQRLHGLSAFSLHSYSPGEIN-
RVAACLRKLGVPPLRAWRHR ARSVRARLLSRG-
GRAAICGKYLFNWAVRTKLKLTPIAAAGQLDLSGW-
FTAGYS
GGDIYHSVSHARPRWFWFCLLLLAAGVGIYLLPNR
(SEQ ID NO:13); and has a length of 1985 amino acids. Such a polytope can include T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10, NS5a-1, NS5a-2, NS5b-1, NS5b-2 in FIGS. 13A-13B and FIGS. 15A-15N.

Additional T-cell Epitopes

As discussed above, an E1/E2 a heterodimeric polypeptide of the present disclosure includes: a) an HCV E2 polypeptide; and b) a variant HCV E1 polypeptide comprising: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein.

Thus, in some cases, a variant HCV E1 polypeptide of an E1/E2 heterodimer of the present disclosure includes: a) an HCV E1 polypeptide; and b) a heterologous polypeptide that comprises one or more T-cell epitopes, where the one or more T-cell epitopes are T-cell epitopes present in: i) one or more of an HCV NS3 polypeptide, an HCV NS2 polypeptide, an HCV NS4A polypeptide, an HCV NS4B polypeptide, an HCV NS5A polypeptide, an HCV NS5B polypeptide, an HCV core polypeptide, and an HCV p7 polypeptide; and ii) one or more of cholera toxin or toxoid, tetanus toxin or toxoid, diphtheria toxin or toxoid, and a meningococcal outer membrane protein.

Additional T-cell Epitopes

As discussed above, an E1/E2 a heterodimeric polypeptide of the present disclosure includes: a) an HCV E1 polypeptide; and b) a variant HCV E2 polypeptide comprising: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein.

Thus, in some cases, a variant HCV polypeptide of an E1/E2 heterodimer of the present disclosure includes: a) an HCV E2 polypeptide; and b) a heterologous polypeptide that comprises one or more T-cell epitopes, where the one or more T-cell epitopes are T-cell epitopes present in: i) one or more of an HCV NS3 polypeptide, an HCV NS2 polypeptide, an HCV NS4A polypeptide, an HCV NS4B polypeptide, an HCV NS5A polypeptide, an HCV NS5B polypeptide, an HCV core polypeptide, and an HCV p7 polypeptide; and ii) one or more of cholera toxin or toxoid, tetanus toxin or toxoid, diphtheria toxin or toxoid, and a meningococcal outer membrane protein.

A T helper tetanus toxin epitope or other bacterial T-cell epitope could be fused (e.g., by recombinant expression) or chemically conjugated to the HCV polytope/E2 fusion protein and/or to the HCV polytope E1 fusion protein of an E1/E2 heterodimer of the present disclosure to further enhance both T and B cell responses to both the HCV polytope and E1/E2 moieties. Alternatively, the whole or part of the detoxified toxin ("toxoid") could be fused (e.g., by recombinant expression) or chemically conjugated to the HCV polytope/E1E2 protein, wherein specific amino acids of the toxins are mutated to render the toxins inactive, thereby generating toxoids. Methods of generating toxoids are well known in the art. Examples of bacterial epitopes include the use of diphtheria toxoid, meningococcal outer membrane protein, or mutant diphtheria protein CRM197 (see, e.g.: www(dot)medscape(dot)com/viewarticle/431127)

In some cases, a suitable tetanus toxoid polypeptide comprises the amino acid sequence QYIKANSKFIGIFE (SEQ ID NO: 14). In some cases, a suitable tetanus toxoid polypeptide comprises the amino acid sequence QYIKANSKFIGITE (SEQ ID NO:65).

In some cases, a heterologous polypeptide can comprise cholera toxin (or toxoid) epitope. In some cases, a suitable heterologous polypeptide comprising a cholera toxoid epitope comprises a fragment of cholera toxin-B subunit (CT-B), e.g., a fragment of from 5 amino acids to 25 amino acids, or from 25 amino acids to 50 amino acids, of the following amino acid sequence: MIKLKFGVFF TVLLSSAYAH GTPQNITDLC AEYHNTQIHT LNDKIF- SYTE SLAGKREMAI ITFKNGATFQ VEVPGSQHID SQKKAIERMK DTLRIAYLTE AKVEKLCVWN NKT- PHAIAAI SMAN (SEQ ID NO:15).

In some cases, a heterologous polypeptide can comprise a tetanus toxin (or toxoid) T-cell epitope. In some cases, a suitable heterologous polypeptide comprising a tetanus toxin T-cell epitope comprises the amino acid sequence: ILMQYIKANSKFIGI (SEQ ID NO:16); and has a length of from 15 amino acids to 20 amino acids. In some cases, a suitable heterologous polypeptide comprising a tetanus toxin T-cell epitope comprises the amino acid sequence: VNNESSE (SEQ ID NO: 17). In some cases, a suitable heterologous polypeptide comprising a tetanus toxin T-cell epitope comprises the amino acid sequence: PGING- KAIHLVNNESSE (SEQ ID NO: 18). In some cases, a suitable heterologous polypeptide comprising a tetanus toxin T-cell epitope comprises the amino acid sequence: PNRDIL (SEQ ID NO: 19). In some cases, a suitable heterologous polypeptide comprising a tetanus toxin T-cell epitope comprises the amino acid sequence: FIGITEL (SEQ ID NO:20). In some cases, a suitable tetanus toxin T-cell epitope comprises the amino acid sequence: SYFPSV (SEQ ID NO:21). In some cases, a suitable heterologous polypeptide comprising a tetanus toxin T-cell epitope comprises the amino acid sequence: NSVDDALINSTKIYSYFPSV (SEQ ID NO:22). In some cases, a suitable heterologous polypeptide comprising a tetanus toxin T-cell epitope comprises the amino acid sequence: IDKISDVSTIVPYIGPALNI (SEQ ID NO:23).

In some cases, a heterologous polypeptide can comprise a diphtheria toxin T-cell epitope In some cases, a suitable heterologous polypeptide comprising a diphtheria toxin T-cell epitope comprises the amino acid sequence: QSIALSSLMVAQAIP (SEQ ID NO:24); and has a length of from 15 amino acids to 20 amino acids. In some cases, a suitable heterologous polypeptide comprising a diphtheria toxin T-cell epitope comprises the amino acid sequence: PVFAGANYAAWAVNVAQVI (SEQ ID NO:25). In some cases, a suitable heterologous polypeptide comprising a diphtheria toxin T-cell epitope comprises the amino acid sequence: VHHNTEEIVAQSIALSSLMV (SEQ ID NO:26). In some cases, a suitable heterologous polypeptide comprising a diphtheria toxin T-cell epitope comprises the amino acid sequence: QSIALSSLMVAQAIPLVGEL (SEQ ID NO:66). In some cases, a suitable heterologous polypeptide comprising a diphtheria toxin T-cell epitope comprises the amino acid sequence: VDIGFAAYNFVESIINLFQV (SEQ ID NO:67). In some cases, a suitable heterologous polypeptide comprising a diphtheria toxin T-cell epitope comprises the amino acid sequence: QGESGHDIKITAENTPLPIA (SEQ ID NO:68). In some cases, a suitable heterologous polypeptide comprising a diphtheria toxin T-cell epitope comprises the amino acid sequence: GVLLPTIPGKLD- VNKSKTHI (SEQ ID NO:69). In some cases, a suitable heterologous polypeptide comprising a diphtheria toxin T-cell epitope comprises the amino acid sequence of CRM197 (see, e.g., Giannini et al. (1984) Nucl. Acids. Res. 12:4063). The amino acid sequence of CRM197 is provided above.

In some cases, a heterologous polypeptide can comprise a tetanus toxin T-cell epitope and a diphtheria T-cell epitope. In some of these cases, the heterologous polypeptide can comprise the amino acid sequence: IMQYIKAN- SKFIGIQSIALSSLMVAQ (SEQ ID NO:28); and can have a length of from 26 amino acids to 30 amino acids.

E2

An E2 polypeptide suitable for inclusion in an E1/E2 heterodimer of the present disclosure can have a length of from about 200 amino acids (aa) to about 250 aa, from about 250 aa to about 275 aa, from about 275 aa to about 300 aa, from about 300 aa to about 325 aa, from about 325 aa to about 350 aa, or from about 350 aa to about 365 aa. In some cases, an E2 polypeptide suitable for inclusion in an E1/E2 heterodimer of the present disclosure is a full-length HCV E2 polypeptide. In some cases, an E2 polypeptide suitable for inclusion in an E1/E2 heterodimer of the present disclosure is an HCV E2 ectodomain polypeptide.

In FIGS. 1A-AC, the amino acid sequence of E2 is amino acid 384 to amino acid 746. In FIGS. 2A-2B, the amino acid sequence of E2 is amino acid 384 to amino acid 751. In FIGS. 3A-3C, the amino acid sequence of E2 is amino acid 385 to amino acid 754. In FIGS. 4A-4B, the amino acid sequence of E2 is amino acid 384 to amino acid 750. As used herein, an "E2 polypeptide" includes a precursor E2 protein, including the signal sequence; includes a mature E2 poly- peptide which lacks this sequence; and includes an E2 polypeptide with a heterologous signal sequence. An E2 polypeptide can include a C-terminal membrane anchor sequence which occurs at approximately amino acid posi- tions 715-730 and may extend as far as approximately amino acid residue 746 (see, Lin et al., J. Virol. (1994) 68:5063- 5073).

In some cases, a E2 polypeptide suitable for inclusion in an E1/E2 heterodimer of the present disclosure lacks a portion of its C-terminal region, e.g., from about amino acid 715 to the C-terminus; from about amino acid 625 to the C-terminus; from about amino acid 661 to the C-terminus; from about amino acid 655 to the C-terminus; from about amino acid 500 to the C-terminus, where the amino acid numbering is with reference to the numbering in FIGS. 1A-1C. See, e.g., U.S. Pat. No. 6,521,423.

An E2 polypeptide suitable for inclusion in an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIGS. 1A-1C, FIGS. 2A-2C, FIGS. 3A-3C, or FIGS. 4A-4B.

An E2 polypeptide suitable for inclusion in an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIGS. 1A-1C. For example, an E2 polypeptide of genotype 1 can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence depicted in FIGS. 1A-1C. For example, an E2 polypeptide of genotype 1A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence identified as 1A and depicted in FIGS. 1A-1C. For example, an E2 polypeptide of genotype 1B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence identified as 1B and depicted in FIGS. 1A-1C. For example, an E2 polypeptide of genotype 1C can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence identified as 1C and depicted in FIGS. 1A-1C.

An E2 polypeptide suitable for inclusion in an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIGS. 2A-2C. For example, an E2 polypeptide can comprise an amino acid sequence having having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence depicted in FIGS. 2A-2C. For example, an E2 polypeptide of genotype 2A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-751 of the "consensus" amino acid sequence depicted in FIGS. 2A-2C. For example, an E2 polypeptide of genotype 2B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-751 of the "consensus" amino acid sequence depicted in FIGS. 2A-2C.

An E2 polypeptide suitable for inclusion in an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIGS. 3A-3C. For example, an E2 polypeptide of genotype 3 can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of an amino acid sequence depicted in FIGS. 3A-3C. For example, an E2 polypeptide of genotype 3A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of an amino acid sequence identified as 3A and depicted in FIGS. 3A-3C. For example, an E2 polypeptide of genotype 3B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of the amino acid sequence identified as 3B and depicted in FIGS. 3A-3C. For example, an E2 polypeptide of genotype 3K can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of the amino acid sequence identified as 3K and depicted in FIGS. 3A-3C.

An E2 polypeptide suitable for inclusion in an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the amino acid sequence of the E2 polypeptide depicted in FIGS. 4A-4B. For example, an E2 polypeptide of genotype 7A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-750 of the amino acid sequence depicted in FIGS. 4A-4B.

Additional Polypeptides

In any of the above-described embodiments, one or both of the polypeptide chains of the E1/E2 heterodimer can include one or more additional polypeptides. For example, in some cases, the variant E1 polypeptide or the E2 polypeptide can include an Ig Fc polypeptide at the C-terminus of the variant E1 polypeptide or the E2 polypeptide. As another example, in some cases, the variant E1 polypeptide or the E2 polypeptide can include an Ig Fc polypeptide at the N-terminus of the variant E1 polypeptide or the E2 polypeptide. Ig Fc polypeptides are known in the art, and are described elsewhere herein.

IC. E1E2 Heterodimers Comprising a Variant HCV E1 and a Variant HCV E2

The present disclosure provides an E1/E2 heterodimer, where the E1/E2 heterodimer includes both a variant E1 polypeptide and a variant E2 polypeptide.

Thus, in some cases, a heterodimeric polypeptide of the present disclosure includes: a) a variant HCV E1 polypeptide comprising: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide); and b) a variant HCV E2 polypeptide comprising: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein. In some cases, a variant HCV E2 and a variant HCV E1 polypeptide of an E1/E2 heterodimer of the present disclosure includes: 1) a) an HCV E2 polypeptide; and b) a heterologous polypeptide that comprises one or more T-cell epitopes, where the one or more T-cell epitopes are T-cell epitopes present in: i) one or more of an HCV NS3 polypeptide, an HCV NS2 polypeptide, an HCV NS4A polypeptide, an HCV NS4B polypeptide, an HCV NS5A polypeptide, an HCV NS5B polypeptide, an HCV core polypeptide, and an HCV p7 polypeptide; and ii) one or more of cholera toxin or toxoid, tetanus toxin or toxoid, diphtheria toxin or toxoid, and a meningococcal outer membrane protein; and 2) a) an HCV E1 polypeptide; and b) a heterologous polypeptide that comprises one or more T-cell epitopes, where the one or more T-cell epitopes are T-cell epitopes present in: i) one or more of an HCV NS3 polypeptide, an HCV NS2 polypeptide, an HCV NS4A polypeptide, an HCV NS4B polypeptide, an HCV NS5A polypeptide, an HCV NS5B polypeptide, an HCV core polypeptide, and an HCV p7 polypeptide; and ii) one or more of cholera toxin or toxoid, tetanus toxin or toxoid, diphtheria toxin or toxoid, and a meningococcal outer membrane protein.

In some cases, a variant E2 polypeptide present in an E1/E2 heterodimer of the present disclosure comprises, in order from N-terminus to C-terminus: i) an HCV E2 polypeptide; and ii) a heterologous polypeptide comprising one or more T cell epitopes. In some cases, a variant HCV E2 polypeptide present in an E1/E2 heterodimer of the present disclosure comprises, in order from N-terminus to C-terminus: i) a heterologous polypeptide comprising one or more T cell epitopes; and ii) an HCV E2 polypeptide. In some cases, a variant E1 polypeptide present in an E1/E2 heterodimer of the present disclosure comprises, in order from N-terminus to C-terminus: i) an HCV E1 polypeptide; and ii) a heterologous polypeptide comprising one or more T cell epitopes. In some cases, a variant HCV E1 polypeptide present in an E1/E2 heterodimer of the present disclosure comprises, in order from N-terminus to C-terminus: i) a heterologous polypeptide comprising one or more T cell epitopes; and ii) an HCV E1 polypeptide. In some cases, both the variant E1 and the variant E2 polypeptide include the heterologous polypeptide at the N-terminus of the E1 and E2 polypeptides. In some cases, both the variant E1 and the variant E2 polypeptide include the heterologous polypeptide at the C-terminus of the E1 and E2 polypeptides. In some cases, the variant E1 polypeptide comprises the heterologous polypeptide at the N-terminus of the E1 polypeptide; and the variant E2 polypeptide comprises the heterologous polypeptide at the C-terminus of the E2 polypeptide. In some cases, the variant E1 polypeptide comprises the heterologous polypeptide at the C-terminus of the E1 polypeptide; and the variant E2 polypeptide comprises the heterologous polypeptide at the N-terminus of the E2 polypeptide.

Variant E1

As noted above, a variant E1 polypeptide of an HCV E1/E2 heterodimer of the present disclosure comprises: i) an HCV E1 polypeptide; and ii) a heterologous polypeptide comprising one or more T cell epitopes (e.g., one or more T-cell epitopes not present in an HCV E1 or an HCV E2 polypeptide; e.g., one or more T-cell epitopes present in an HCV polypeptide other than an HCV E1 or an HCV E2 polypeptide). In some cases, the variant HCV E1 polypeptide comprises, in order from amino terminus (N-terminus) to carboxyl terminus (C-terminus): i) an HCV E1 polypeptide; and ii) a heterologous polypeptide comprising one or more T cell epitopes. In some cases, the variant HCV E1 polypeptide comprises, in order from N-terminus to C-terminus: i) a heterologous polypeptide comprising one or more T cell epitopes; and ii) an HCV E1 polypeptide.

E1

An HCV E1 polypeptide suitable for inclusion in a variant E1 polypeptide of an E1/E2 heterodimer of the present disclosure can have a length of from about 150 amino acids (aa) to about 175 aa, from about 175 aa to about 195 aa, from about 131 aa to about 175 aa, or from about 175 aa to about 193 aa. In some cases, an E1 polypeptide suitable for inclusion in a variant E1 polypeptide of an HCV E1/E2 heterodimer of the present disclosure is a full-length HCV E1 polypeptide. In some cases, an E1 polypeptide suitable for inclusion in a variant E1 polypeptide of an HCV E1/E2 heterodimer of the present disclosure is an HCV E1 ectodomain polypeptide.

In FIGS. 1A-1C, the amino acid sequence of E1 is amino acid 192 to amino acid 383. In FIGS. 2A-2C, the amino acid sequence of E1 is amino acid 192 to amino acid 383. In FIGS. 3A-3C, the amino acid sequence of E1 is amino acid 192 to amino acid 384. In FIGS. 4A-4B, the amino acid sequence of E1 is amino acid 192 to amino acid 383. Amino acids at around 170 through approximately 191 serve as a signal sequence for E1. As used herein, "E1 polypeptide" includes a precursor E1 protein, including the signal sequence; includes a mature E1 polypeptide which lacks this sequence; and includes an E1 polypeptide with a heterologous signal sequence. An E1 polypeptide can include a C-terminal membrane anchor sequence which occurs at approximately amino acid positions 360-383 (see, e.g., WO 96/04301). In some cases, a suitable E1 polypeptide lacks a C-terminal portion that includes a transmembrane region. For example, in some cases, a suitable E1 polypeptide lacks the C-terminal portion from amino acid 330 to amino acid 384, or from amino acid 360 to amino acid 384. E1 polypeptides can be an E1 polypeptide of any genotype, subtype or isolate of HCV. E1 polypeptides of genotype 1 and E1 polypeptides of genotype 3 are included in an E1/E2 heterodimer of the present disclosure.

An E1 polypeptide suitable for inclusion in a variant E1 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIGS. 1A-1C, FIGS. 2A-2C, FIGS. 3A-3C, or FIGS. 4A-4B.

An E1 polypeptide suitable for inclusion in a variant E1 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIGS. 1A-1C. For example, an E1 polypeptide of genotype 1A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 1A and depicted in FIGS. 1A-1C. For example, an E1 polypeptide of genotype 1B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 1B and depicted in FIGS. 1A-1C. For example, an E1 polypeptide of genotype 1C can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 1C and depicted in FIGS. 1A-1C.

An E1 polypeptide suitable for inclusion in a variant E1 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIGS. 2A-2C. For example, an E1 polypeptide of genotype 2A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 2A and depicted in FIGS. 2A-2C. For example, an E1 polypeptide of genotype 2B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 2B and depicted in FIGS. 2A-2C.

An E1 polypeptide suitable for inclusion in a variant E1 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the consensus E1 polypeptide amino acid sequence depicted in FIGS. 3A-3C.

An E1 polypeptide suitable for inclusion in a variant E1 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIGS. 4A-4B. For example, an E1 polypeptide of genotype 7A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of the amino acid sequence depicted in FIGS. 4A-4B.

Variant E2

As noted above, a variant E2 polypeptide of an HCV E1/E2 heterodimer of the present disclosure comprises: i) an HCV E2 polypeptide; and ii) a heterologous polypeptide comprising one or more T cell epitopes (e.g., one or more T-cell epitopes not present in an HCV E1 or an HCV E2 polypeptide; e.g., one or more T-cell epitopes present in an HCV polypeptide other than an HCV E1 or an HCV E2 polypeptide). In some cases, the variant HCV E2 polypeptide comprises, in order from amino terminus (N-terminus) to carboxyl terminus (C-terminus): i) an HCV E2 polypeptide; and ii) a heterologous polypeptide comprising one or more T cell epitopes. In some cases, the variant HCV E2 polypeptide comprises, in order from N-terminus to C-terminus: i) a heterologous polypeptide comprising one or more T cell epitopes; and ii) an HCV E2 polypeptide.

In some cases, a variant E2 polypeptide of an HCV E1/E2 heterodimer of the present disclosure comprises from 1 to 10 amino acids at the N-terminus of the variant E2 polypeptide, which 1 to 10 amino acids are part of a cleavable linker that remains following cleavage of a polyprotein precursor, as described below. For example, where the cleavable linker comprises the amino acid sequence LEVLFQGP (SEQ ID NO:5), the variant E2 polypeptide can comprise Gly-Pro residues at the N-terminus of the polypeptide, e.g., as depicted in FIG. 5A.

E2

An E2 polypeptide suitable for inclusion in a variant E2 polypeptide of an E1/E2 heterodimer of the present disclosure can have a length of from about 200 amino acids (aa) to about 250 aa, from about 250 aa to about 275 aa, from about 275 aa to about 300 aa, from about 300 aa to about 325 aa, from about 325 aa to about 350 aa, or from about 350 aa to about 365 aa. In some cases, an E2 polypeptide suitable for inclusion in a variant E2 polypeptide of an HCV E1/E2 heterodimer of the present disclosure is a full-length HCV E1 polypeptide. In some cases, an E2 polypeptide suitable for inclusion in a variant E1 polypeptide of an HCV E1/E2 heterodimer of the present disclosure is an HCV E2 ectodomain polypeptide.

In FIGS. 1A-AC, the amino acid sequence of E2 is amino acid 384 to amino acid 746. In FIGS. 2A-2B, the amino acid sequence of E2 is amino acid 384 to amino acid 751. In FIGS. 3A-3C, the amino acid sequence of E2 is amino acid 385 to amino acid 754. In FIGS. 4A-4B, the amino acid sequence of E2 is amino acid 384 to amino acid 750. As used herein, an "E2 polypeptide" includes a precursor E2 protein, including the signal sequence; includes a mature E2 polypeptide which lacks this sequence; and includes an E2 polypeptide with a heterologous signal sequence. An E2 polypeptide can include a C-terminal membrane anchor sequence which occurs at approximately amino acid positions 715-730 and may extend as far as approximately amino acid residue 746 (see, Lin et al., J. Virol. (1994) 68:5063-5073).

In some cases, a E2 polypeptide suitable for inclusion in a variant E2 polypeptide of an E1/E2 heterodimer of the present disclosure lacks a portion of its C-terminal region, e.g., from about amino acid 715 to the C-terminus; from about amino acid 625 to the C-terminus; from about amino acid 661 to the C-terminus; from about amino acid 655 to the C-terminus; from about amino acid 500 to the C-terminus, where the amino acid numbering is with reference to the numbering in FIGS. 1A-1C. See, e.g., U.S. Pat. No. 6,521,423.

An E2 polypeptide suitable for inclusion in a variant E2 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIGS. 1A-1C, FIGS. 2A-2C, FIGS. 3A-3C, or FIGS. 4A-4B.

An E2 polypeptide suitable for inclusion in a variant E2 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIGS. 1A-1C. For example, an E2 polypeptide of genotype 1 can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence depicted in FIGS. 1A-1C. For example, an E2 polypeptide of genotype 1A can comprise an amino acid sequence having having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence identified as 1A and depicted in FIGS. 1A-1C. For example, an E2 polypeptide of genotype 1B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence identified as 1B and depicted in FIGS. 1A-1C. For example, an E2 polypeptide of genotype 1C can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence identified as 1C and depicted in FIGS. 1A-1C.

An E2 polypeptide suitable for inclusion in a variant E2 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIGS. 2A-2C. For example, an E2 polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence depicted in FIGS. 2A-2C. For example, an E2 polypeptide of genotype 2A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-751 of the "consensus" amino acid sequence depicted in FIGS. 2A-2C. For example, an E2 polypeptide of genotype 2B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-751 of the "consensus" amino acid sequence depicted in FIGS. 2A-2C.

An E2 polypeptide suitable for inclusion in a variant E2 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIGS. 3A-3C. For example, an E2 polypeptide of genotype 3 can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of an amino acid sequence depicted in FIGS. 3A-3C. For example, an E2 polypeptide of genotype 3A can comprise an amino acid sequence having having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of an amino acid sequence identified as 3A and depicted in FIGS. 3A-3C. For example, an E2 polypeptide of genotype 3B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of the amino acid sequence identified as 3B and depicted in FIGS. 3A-3C. For example, an E2 polypeptide of genotype 3K can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of the amino acid sequence identified as 3K and depicted in FIGS. 3A-3C.

An E2 polypeptide suitable for inclusion in a variant E2 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the amino acid sequence of the E2 polypeptide depicted in FIGS. 4A-4B. For example, an E2 polypeptide of genotype 7A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-750 of the amino acid sequence depicted in FIGS. 4A-4B.

Heterologous Polypeptide

As noted above, in some embodiments, an E1/E2 heterodimer of the present disclosure comprises: a) a variant E1 polypeptide comprising: i) an HCV E1 polypeptide; and 2) a heterologous polypeptide comprising one or more T cell epitopes (e.g., one or more T-cell epitopes not present in an HCV E1 or an HCV E2 polypeptide; e.g., one or more T-cell epitopes present in an HCV polypeptide other than an HCV E1 or an HCV E2 polypeptide); and b) a variant E2 polypeptide comprising: i) an HCV E2 polypeptide; and 2) a heterologous polypeptide comprising one or more T cell epitopes (e.g., one or more T-cell epitopes not present in an HCV E1 or an HCV E2 polypeptide; e.g., one or more T-cell epitopes present in an HCV polypeptide other than an HCV E1 or an HCV E2 polypeptide).

In some cases, the heterologous polypeptide comprises 1, 2, 3, 4, 5, 6, 7, 8, 9, or 10, or more than 10 (e.g., from 10 to 15, from 15 to 20, from 20 to 25, or from 25 to 30, or more than 30), T cell epitopes. T-cell epitopes are epitopes that, when presented with a major histocompatibility complex (MHC) (e.g., a human leukocyte antigen (HLA)) Class I or MHC Class II molecule, are recognized and bound by a T-cell receptor (TCR) present on a T cell surface. T-cell epitopes include epitopes recognized by cytotoxic T cells (e.g., $CD8^+$ T cells), and epitopes recognized by helper T cells (e.g., $CD4^+$ T cells).

The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein. Other examples of strong T helper epitopes are diphtheria toxoid, tetanus toxoid, meningococcal outer membrane protein, or mutant diphtheria protein CRM197 (see, e.g.: www(dot)medscape(dot)com/viewarticle/431127).

In some cases, the heterologous polypeptide comprises a single T-cell epitope. In some cases, the heterologous polypeptide comprises a single HCV-NS3 T-cell epitope. In some cases, the heterologous polypeptide comprises 2 or more T-cell epitopes. In some cases, the heterologous polypeptide comprises 2 or more HCV-NS3 T-cell epitopes. In some cases, the heterologous polypeptide comprises 3 or more HCV-NS3 T-cell epitopes. In some cases, the heterologous polypeptide comprises 4 or more HCV-NS3 T-cell epitopes. In some cases, the heterologous polypeptide comprises a single HCV-NS3 CD4+ T-cell epitope. In some cases, the heterologous polypeptide comprises 2 or more HCV-NS3 CD4+ T-cell epitopes. In some cases, the heterologous polypeptide comprises one or more HCV CD8+ T cell epitopes. In some cases, the heterologous polypeptide comprises a single HCV-NS3 CD8+ T-cell epitope. In some cases, the heterologous polypeptide comprises 2 or more HCV-NS3 CD8+ T-cell epitopes. In some cases, the heterologous polypeptide comprises at least one HCV CD4+ T cell epitope and at least one HCV CD8+ T cell epitope. In some cases, the heterologous polypeptide comprises at least one HCV-NS3 CD4+ T cell epitope and at least one HCV-NS3 CD8+ T cell epitope. In some cases, heterologous polypeptide comprises 2 or more HCV-NS3 CD4+ T-cell epitopes and 2 or more HCV-NS3 CD8+ T-cell epitopes. In some cases, the heterologous polypeptide comprises 2, 3, 4, or 5 HCV-NS3 CD4+ T-cell epitopes and 2, 3, 4, or 5 HCV-NS3 CD8+ T-cell epitopes.

In some cases, the heterologous polypeptide comprises a single T-cell epitope. In some cases, the heterologous polypeptide comprises a single HCV-NS2 T-cell epitope. In some cases, the heterologous polypeptide comprises 2 or more T-cell epitopes. In some cases, the heterologous polypeptide comprises 2 or more HCV-NS2 T-cell epitopes. In some cases, the heterologous polypeptide comprises 3 or more HCV-NS2 T-cell epitopes. In some cases, the heterologous polypeptide comprises 4 or more HCV-NS2 T-cell epitopes. In some cases, the heterologous polypeptide comprises a single HCV-NS2 CD4+ T-cell epitope. In some cases, the heterologous polypeptide comprises 2 or more HCV-NS2 CD4+ T-cell epitopes. In some cases, the heterologous polypeptide comprises one or more HCV CD8+ T cell epitopes. In some cases, the heterologous polypeptide comprises a single HCV-NS2 CD8+ T-cell epitope. In some cases, the heterologous polypeptide comprises 2 or more HCV-NS2 CD8+ T-cell epitopes. In some cases, the heterologous polypeptide comprises at least one HCV CD4+ T cell epitope and at least one HCV CD8+ T cell epitope. In some cases, the heterologous polypeptide comprises at least one HCV-NS2 CD4+ T cell epitope and at least one HCV-NS2 CD8+ T cell epitope. In some cases, heterologous polypeptide comprises 2 or more HCV-NS2 CD4+ T-cell epitopes and 2 or more HCV-NS2 CD8+ T-cell epitopes. In some cases, the heterologous polypeptide comprises 2, 3, 4, or 5 HCV-NS2 CD4+ T-cell epitopes and 2, 3, 4, or 5 HCV-NS2 CD8+ T-cell epitopes.

In some cases, the heterologous polypeptide comprises a single T-cell epitope. In some cases, the heterologous polypeptide comprises a single HCV-NS4A T-cell epitope. In some cases, the heterologous polypeptide comprises 2 or more T-cell epitopes. In some cases, the heterologous polypeptide comprises 2 or more HCV-NS4A T-cell epitopes. In some cases, the heterologous polypeptide comprises 3 or more HCV-NS4A T-cell epitopes. In some cases, the heterologous polypeptide comprises 4 or more HCV-NS4A T-cell epitopes. In some cases, the heterologous polypeptide comprises a single HCV-NS4A CD4+ T-cell epitope. In some cases, the heterologous polypeptide comprises 2 or more HCV-NS4A CD4+ T-cell epitopes. In some cases, the heterologous polypeptide comprises one or more HCV CD8+ T cell epitopes. In some cases, the heterologous polypeptide comprises a single HCV-NS4A CD8+ T-cell epitope. In some cases, the heterologous polypeptide comprises 2 or more HCV-NS4A CD8+ T-cell epitopes. In some cases, the heterologous polypeptide comprises at least one HCV CD4+ T cell epitope and at least one HCV CD8+ T cell epitope. In some cases, the heterologous polypeptide comprises at least one HCV-NS4A CD4+ T cell epitope and at least one HCV-NS4A CD8+ T cell epitope. In some cases, heterologous polypeptide comprises 2 or more HCV-NS4A CD4+ T-cell epitopes and 2 or more HCV-NS4A CD8+ T-cell epitopes. In some cases, the heterologous polypeptide comprises 2, 3, 4, or 5 HCV-NS4A CD4+ T-cell epitopes and 2, 3, 4, or 5 HCV-NS4A CD8+ T-cell epitopes.

In some cases, the heterologous polypeptide comprises a single T-cell epitope. In some cases, the heterologous polypeptide comprises a single HCV-NS5A T-cell epitope. In some cases, the heterologous polypeptide comprises 2 or more T-cell epitopes. In some cases, the heterologous polypeptide comprises 2 or more HCV-NS5A T-cell epitopes. In some cases, the heterologous polypeptide comprises 3 or more HCV-NS5A T-cell epitopes. In some cases, the heterologous polypeptide comprises 4 or more HCV-NS5A T-cell epitopes. In some cases, the heterologous polypeptide comprises a single HCV-NS5A CD4+ T-cell epitope. In some cases, the heterologous polypeptide comprises 2 or more HCV-NS5A CD4+ T-cell epitopes. In some cases, the heterologous polypeptide comprises one or more HCV CD8+ T cell epitopes. In some cases, the heterologous polypeptide comprises a single HCV-NS5A CD8+ T-cell epitope. In some cases, the heterologous polypeptide comprises 2 or more HCV-NS5A CD8+ T-cell epitopes. In some cases, the heterologous polypeptide comprises at least one HCV CD4+ T cell epitope and at least one HCV CD8+ T cell epitope. In some cases, the heterologous polypeptide comprises at least one HCV-NS5A CD4+ T cell epitope and at least one HCV-NS5A CD8+ T cell epitope. In some cases, heterologous polypeptide comprises 2 or more HCV-NS5A CD4+ T-cell epitopes and 2 or more HCV-NS5A CD8+ T-cell epitopes. In some cases, the heterologous polypeptide comprises 2, 3, 4, or 5 HCV-NS5A CD4+ T-cell epitopes and 2, 3, 4, or 5 HCV-NS5A CD8+ T-cell epitopes.

In some cases, the heterologous polypeptide comprises a single T-cell epitope. In some cases, the heterologous polypeptide comprises a single HCV-NS5B T-cell epitope. In some cases, the heterologous polypeptide comprises 2 or more T-cell epitopes. In some cases, the heterologous polypeptide comprises 2 or more HCV-NS5B T-cell epitopes. In some cases, the heterologous polypeptide comprises 3 or more HCV-NS5B T-cell epitopes. In some cases, the heterologous polypeptide comprises 4 or more HCV-NS5B T-cell epitopes. In some cases, the heterologous polypeptide comprises a single HCV-NS5B CD4+ T-cell epitope. In some cases, the heterologous polypeptide comprises 2 or more HCV-NS5B CD4+ T-cell epitopes. In some cases, the heterologous polypeptide comprises one or more HCV CD8+ T cell epitopes. In some cases, the heterologous polypeptide comprises a single HCV-NS5B CD8+ T-cell epitope. In some cases, the heterologous polypeptide comprises 2 or more HCV-NS5B CD8+ T-cell epitopes. In some cases, the heterologous polypeptide comprises at least one HCV CD4+ T cell epitope and at least one HCV CD8+ T cell epitope. In some cases, the heterologous polypeptide comprises at least one HCV-NS5B CD4+ T cell epitope and at least one HCV-NS5B CD8+ T cell epitope. In some cases, heterologous polypeptide comprises 2 or more HCV-NS5B CD4+ T-cell epitopes and 2 or more HCV-NS5B CD8+ T-cell epitopes. In some cases, the heterologous polypeptide comprises 2, 3, 4, or 5 HCV-NS5B CD4+ T-cell epitopes and 2, 3, 4, or 5 HCV-NS5B CD8+ T-cell epitopes.

In some cases, the heterologous polypeptide comprises a single T-cell epitope. In some cases, the heterologous polypeptide comprises a single HCV-core T-cell epitope. In some cases, the heterologous polypeptide comprises 2 or more T-cell epitopes. In some cases, the heterologous polypeptide comprises 2 or more HCV-core T-cell epitopes. In some cases, the heterologous polypeptide comprises 3 or more HCV-core T-cell epitopes. In some cases, the heterologous polypeptide comprises 4 or more HCV-core T-cell epitopes. In some cases, the heterologous polypeptide comprises a single HCV-core CD4+ T-cell epitope. In some cases, the heterologous polypeptide comprises 2 or more HCV-core CD4+ T-cell epitopes. In some cases, the heterologous polypeptide comprises one or more HCV CD8+ T cell epitopes. In some cases, the heterologous polypeptide comprises a single HCV-core CD8+ T-cell epitope. In some cases, the heterologous polypeptide comprises 2 or more HCV-core CD8+ T-cell epitopes. In some cases, the heterologous polypeptide comprises at least one HCV CD4+ T cell epitope and at least one HCV CD8+ T cell epitope. In some cases, the heterologous polypeptide comprises at least one HCV-core CD4+ T cell epitope and at least one HCV-core CD8+ T cell epitope. In some cases, heterologous polypeptide comprises 2 or more HCV-core CD4+ T-cell epitopes and 2 or more HCV-core CD8+ T-cell epitopes. In some cases, the heterologous polypeptide comprises 2, 3, 4, or 5 HCV-core CD4+ T-cell epitopes and 2, 3, 4, or 5 HCV-core CD8+ T-cell epitopes.

In some cases, the heterologous polypeptide comprises a single T-cell epitope. In some cases, the heterologous polypeptide comprises a single HCV-p7 T-cell epitope. In some cases, the heterologous polypeptide comprises 2 or more T-cell epitopes. In some cases, the heterologous polypeptide comprises 2 or more HCV-p7 T-cell epitopes. In some cases, the heterologous polypeptide comprises 3 or more HCV-p7 T-cell epitopes. In some cases, the heterologous polypeptide comprises 4 or more HCV-p7 T-cell epitopes. In some cases, the heterologous polypeptide comprises a single HCV-p7 CD4+ T-cell epitope. In some cases, the heterologous polypeptide comprises 2 or more HCV-core CD4+ T-cell epitopes. In some cases, the heterologous polypeptide comprises one or more HCV CD8+ T cell epitopes. In some cases, the heterologous polypeptide comprises a single HCV-p7 CD8+ T-cell epitope. In some cases, the heterologous polypeptide comprises 2 or more HCV-p7 CD8+ T-cell epitopes. In some cases, the heterologous polypeptide comprises at least one HCV CD4+ T cell epitope and at least one HCV CD8+ T cell epitope. In some cases, the heterologous polypeptide comprises at least one HCV-p7 CD4+ T cell epitope and at least one HCV-p7 CD8+ T cell epitope. In some cases, heterologous polypeptide comprises 2 or more HCV-p7 CD4+ T-cell epitopes and 2 or more HCV-p7 CD8+ T-cell epitopes. In some cases, the heterologous polypeptide comprises 2, 3, 4, or 5 HCV-p7 CD4+ T-cell epitopes and 2, 3, 4, or 5 HCV-p7 CD8+ T-cell epitopes.

In some cases, the heterologous polypeptide comprises 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, or 63, of the T-cell epitopes set out in FIGS. 13A-13B. In some cases, the heterologous polypeptide comprises from 1 to 3, from 3 to 5, from 5 to 10, from 10 to 15, from 15 to 20, from 20 to 25, or from 25 to 30 of the T-cell epitopes set out in FIGS. 13A-13B. For example, in some cases, the heterologous polypeptide comprises the T-cell epitopes designated NS3-3, NS3-4, and NS3-11 in FIGS. 13A-13B and FIGS. 15A-15N. As another example, in some cases, the heterologous polypeptide comprises the T-cell epitopes designated NS2-1, NS2-2, NS2-3, NS2-7, and NS2-8 in FIGS. 13A-13B and FIGS. 15A-15N. As another example, in some cases, the heterologous polypeptide comprises the T-cell epitopes designated NS3-3, NS3-4, NS3-5, and NS3-11 in FIGS. 13A-13B and FIGS. 15A-15N. As another example, in some cases, the heterologous polypeptide comprises the T-cell epitopes designated NS3-3, NS3-4, NS3-5, NS3-6, NS3-7, NS3-11, NS3-12, and NS3-13 in FIGS. 13A-13B and FIGS. 15A-15N. As another example, in some cases, the heterologous polypeptide comprises the T-cell epitopes designated NS3-3, NS3-4, NS3-5, NS3-6, NS3-7, NS3-10, NS3-11, NS3-12, and NS3-13 in FIGS. 13A-13B and FIGS. 15A-15N. As another example, in some cases, the heterologous polypeptide comprises the T-cell epitopes designated Core-1, Core-2, Core-3, Core-4, Core-5, Core-6, Core-7, Core-8, Core-9, Core-10, Core-11, Core-12, Core-13, Core-14, Core-16, Core-17, Core-18, Core-19, Core-20, Core-21, and Core-22 in FIGS. 13A-13B and FIGS. 15A-15N. As another example, in some cases, the heterologous polypeptide comprises the T-cell epitopes designated NS3-1, NS3-2, NS3-3, NS3-4, NS3-5, NS3-6, NS3-7, NS3-9, NS3-10, NS3-11, NS3-12, and NS3-13 in FIGS. 13A-13B and FIGS. 15A-15N. As another example, in some cases, the heterologous polypeptide comprises the T-cell epitopes designated NS2-1, NS2-2, NS2-3, NS2-4, NS2-5, NS2-6, NS2-7, NS2-8, NS3-1, NS3-2, NS3-3, NS3-4, NS3-5, NS3-6, NS3-7, NS3-9, NS3-10, NS3-11, NS3-12, and NS3-13 in FIGS. 13A-13B and FIGS. 15A-15N. As another example, in some cases, the heterologous polypeptide comprises the T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, and NS4b-10 in FIGS. 13A-13B and FIGS. 15A-15N. As another example, in some cases, the heterologous polypeptide comprises the T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10, NS5a-1, NS5a-2, NS5b-1, and NS5b-2 in FIGS. 13A-13B and FIGS. 15A-15N. In some cases, the T-cell epitopes are contiguous. In some cases, any two T-cell epitopes are separated by linkers (e.g., a linker having a length of from 1 amino acid to about 50 amino acids, e.g., from 1 amino acid to 5 amino acids (aa), from 5 aa to 10 aa, from 10 aa to 15 aa, from 15 aa to 20 aa, from 20 aa to 25 aa, from 25 aa to 30 aa, from 30 aa to 40 aa, or from 40 aa to 50 aa).

In some cases, the heterologous polypeptide comprises at least one HCV CD4+ T cell epitope and at least one HCV CD8+ T cell epitope, where epitopes are conserved among HCV genotypes 1 and 2. In some cases, the heterologous polypeptide comprises at least one HCV CD4+ T cell epitope and at least one HCV CD8+ T cell epitope, where epitopes are conserved among HCV genotypes 1 and 3. In some cases, the heterologous polypeptide comprises at least one HCV CD4+ T cell epitope and at least one HCV CD8+ T cell epitope, where epitopes are conserved among HCV genotypes 1, 2, and 3. In some cases, the heterologous polypeptide comprises at least one HCV CD4+ T cell epitope and at least one HCV CD8+ T cell epitope, where epitopes are conserved among HCV genotypes 1, 2, 3, and 7. In some cases, the heterologous polypeptide comprises at least one HCV CD4+ T cell epitope and at least one HCV CD8+ T cell epitope, where epitopes are conserved among HCV genotypes 1-7.

The heterologous polypeptide can have a length of from about 10 amino acids to about 2000 amino acids; e.g., the heterologous polypeptide can have a length of from 10 amino acids (aa) to 15 aa, from 15 aa to 20 aa, from 20 aa to 25 aa, from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The heterologous polypeptide can have a length of from about 25 amino acids to about 2000 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 500 aa, from 500 aa to 600 aa, from 600 aa to 700 aa, from 700 aa to 800 aa, from 800 aa to 900 aa, from 900 aa to 1000 aa, from 1000 aa to 1100 aa, from 1100 aa to 1200 aa, from 1200 aa to 1300 aa, from 1300 aa to 1400 aa, from 1400 aa to 1500 aa, from 1500 aa to 1600 aa, from 1600 aa to 1700 aa, from 1700 aa to 1800 aa, from 1800 aa to 1900 aa, or from 1900 aa to 2000 aa. The heterologous polypeptide can have a length of from about 25 amino acids to about 3000 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 500 aa, from 500 aa to 600 aa, from 600 aa to 700 aa, from 700 aa to 800 aa, from 800 aa to 900 aa, from 900 aa to 1000 aa, from 1000 aa to 1100 aa, from 1100 aa to 1200 aa, from 1200 aa to 1300 aa, from 1300 aa to 1400 aa, from 1400 aa to 1500 aa, from 1500 aa to 1600 aa, from 1600 aa to 1700 aa, from 1700 aa to 1800 aa, from 1800 aa to 1900 aa, from 1900 aa to 2000 aa, from 2000 aa to 2250 aa, from 2250 aa to 2500 aa, from 2500 aa to 2750 aa, or from 2750 aa to 3000 aa.

The heterologous polypeptide can have a length of from about 25 amino acids to about 800 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The heterologous polypeptide can have a length of from about 25 amino acids to about 400 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, or from 350 aa to 400 aa. The heterologous polypeptide can have a length of 25 amino acids (aa), 26 aa, 27 aa, 28 aa, 29 aa, 30 aa, 31 aa, 32 aa, 33 aa, 34 aa, 35 aa, 36 aa, 37 aa, 38 aa, 39 aa, 40 aa, 41 aa, 42 aa, 43 aa, 44 aa, 45 aa, 46 aa, 47 aa, 48 aa, 49 aa, or 50 aa. The heterologous polypeptide can have a length of from about 100 amino acids (aa) to 800 aa, e.g., from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The heterologous polypeptide can have a length of from 25 aa to 30 aa. The heterologous polypeptide can have a length of from 30 aa to 40 aa. The heterologous polypeptide can have a length of from 40 aa to 50 aa. The heterologous polypeptide can have a length of from 50 aa to 60 aa (e.g., 50 aa, 51 aa, 52, aa, 53 aa, 54 aa, 55 aa, 56 aa, 57 aa, 58 aa, 59 aa, or 60 aa). The heterologous polypeptide can have a length of from 60 aa to 70 aa. The heterologous polypeptide can have a length of from 65 aa to 75 aa (e.g., 65, 66, 67, 68, 69, 70, 71, 72, 7, 74, or 75 aa). The heterologous polypeptide can have a length of 70 aa. The heterologous polypeptide can have a length of from 70 aa to 80 aa. The heterologous polypeptide can have a length of from 80 aa to 90 aa. The heterologous polypeptide can have a length of from 90 aa to 100 aa. The heterologous polypeptide can have a length of from 100 aa to 105 aa (e.g., 100, 101, 102, 103, 104, 105, 106, 107, 108, 109, or 110 aa). The heterologous polypeptide can have a length of 100 aa. The heterologous polypeptide can have a length of from 10 amino acids (aa) to 50 aa; e.g., from 10 aa to 15 aa, from 15 aa to 20 aa, from 20 aa to 25 aa, from 25 aa to 30 aa, from 30 aa to 35 aa, from 35 aa to 40 aa, from 40 aa to 45 aa, or from 45 aa to 50 aa. The heterologous polypeptide can have a length of from 10 amino acids (aa) to 20 aa, e.g., 10, 11, 12, 13, 14, 15, 16, 17, 18, 19, or 20 aa.

HCV NS3 T-cell Epitopes

In some cases, the heterologous polypeptide present in an E2 variant polypeptide of an E1/E2 heterodimer of the present disclosure includes one or more T-cell epitopes present in an HCV NS3 polypeptide. Examples of T-cell epitopes present in NS3 polypeptides are depicted in FIGS. 15A-15N, FIG. 13B, and FIGS. 14A-14B.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKL (SEQ ID NO: 1). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKL (SEQ ID NO: 1); and has a length of from 25 aa to 35 aa (e.g., 25 aa, 26 aa, 27 aa, 28 aa, 29 aa, 30 aa, 31 aa, 32 aa, 33 aa, 34 aa, or 35 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKG-GRHLIFCHSKKKCDELAAKL (SEQ ID NO: 1); and has a length of 29 amino acids. Such a polytope can include NS3 T-cell epitopes designated NS3-3, NS3-4, and NS3-11 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKLVALGI-NAVAYYRGLDVSVIPTSG (SEQ ID NO:2). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKLVALGI-NAVAYYRGLDVSVIPTSG (SEQ ID NO:2); and has a length of from 45 amino acids to 60 amino acids (e.g., 45 aa, 46 aa, 47 aa, 48 aa, 49 aa, 50 aa, 51 aa, 52 aa, 53 aa, 54 aa, 55 aa, 56 aa, 57 aa, 58 aa, 59 aa, or 60 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKLVALGI-NAVAYYRGLDVSVIPTSG (SEQ ID NO:2); and has a length of 52 amino acids. Such a polytope can include NS3 T-cell epitopes designated NS3-3, NS3-4, NS3-5, and NS3-11 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: KGGRHLIFCHSKKKCDELAAKLVALGINAVAYYR-GLDVSVIPTSGDVVVVATDALMTG FTGDFDSVIDCN (SEQ ID NO:3); and has a length of from 65 amino acids to 80 amino acids (e.g., 65 aa, 66 aa, 67 aa, 68 aa, 69 aa, 70 aa, 71 aa, 72 aa, 73 aa, 74 aa, 75 aa, 76 aa, 77 aa, 78 aa, 79 aa, or 80 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: KGGRHLIFCHSKKKCDE-LAAKLVALGINAVAYYRGLDVSVIPTSGDVVVVAT-DALMTG FTGDFDSVIDCN (SEQ ID NO:3); and has a length of 70 amino acids. Such a polytope can include NS3 T-cell epitopes designated NS3-3, NS3-4, NS3-5, NS3-6, NS3-7, NS3-11, NS3-12, and NS3-13 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: VALSTTGEIPFYGKAIPLEVIKGGRHLIFCHSKK-KCDELAAKLVALGINAVAYYRGLDVS VIPTSGDV-VVVATDALMTGFTGDFDSVIDCNTCVTQTVDF (SEQ ID NO:4); and has a length of from 95 amino acids (aa) to 105 aa (e.g., 95 aa, 96 aa, 97 aa, 98 aa, 99 aa, 100 aa, 101 aa, 102 aa, 103 aa, 104 aa, or 105 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: VALSTT-GEIPFYGKAIPLEVIKGGRHLIFCHSKKKCDELAAK-LVALGINAVAYYRGLDVS VIPTSGDVVVVATDALMT-GFTGDFDSVIDCNTCVTQTVDF (SEQ ID NO:4); and has a length of 100 amino acids. Such a polytope can include NS3 T-cell epitopes designated NS3-3, NS3-4, NS3-5, NS3-6, NS3-7, NS3-10, NS3-11, NS3-12, and NS3-13 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQIVG-GVYLLPRRGPRLGVRATRKTSERSQP RGRRQPIP-KARRPEGRTWAQPGYPWPLYGNEGCGWAGWLL-SPRGSRPSWGPTDPRRRS RNLGKVIDTLTCGFADLMGYIPLVGAPLGGAARAL-AHGVRVLEDGVNYATGNLPGCSF SIFLLALLSCLTV-PASA (SEQ ID NO:9); and has a length of from 190 amino acids (aa) to 200 aa (e.g., 190 aa, 191 aa, 192 aa, 193 aa, 194 aa, 195 aa, 196 aa, 197 aa, 198 aa, 199 aa, or 200 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQIVG-GVYLLPRRGPRLGVRATRKTSERSQP RGRRQPIP-KARRPEGRTWAQPGYPWPLYGNEGCGWAGWLL-SPRGSRPSWGPTDPRRRS RNLGKVIDTLTCGFADLMGYIPLVGAPLGGAARAL-AHGVRVLEDGVNYATGNLPGCSF SIFLLALLSCLTV-PASA (SEQ ID NO:9); and has a length of 191 amino acids.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGKSTKVPAAYAAQGYKVLVLNPSVAATLG-FGAYMSKAHGIDPNIRTGVRTIT TGSPITYSTYGK-FLADGGCSGGAYDIIICDECHSTDATSILGIGTV-LDQAETAGARLVVLA TATPPGSVTVPHPNIEEVALSTTGEIPFYGKAIPLEVIK-GGRHLIFCHSKKKCDELAAKLV ALGINAVAYYRGLD-VSVIPTSGDVVVVATDALMTGFTGDFDSVIDCN (SEQ ID NO: 10); and has a length of from 215 amino acids (aa) to 235 aa (e.g., 215 aa, 216 aa, 217 11, 218 aa, 219 aa, 220 aa, 221 aa, 222 aa, 223 aa, 224 aa, 225 aa, 226 aa, 227 aa, 228 aa, 229 aa, 230 aa, 231 aa, 232 aa, 233 aa, 234 aa, or 235 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGKSTKVPAAYAAQGYKVLVL-NPSVAATLGFGAYMSKAHGIDPNIRTGVRTIT TGSPI-TYSTYGKFLADGGCSGGAYDIIICDECHSTDATSIL-GIGTVLDQAETAGARLVVLA TATPPGSVTVPHPNIEEVALSTTGEIPFYGKAIPLEVIK-GGRHLIFCHSKKKCDELAAKLV ALGINAVAYYRGLD-VSVIPTSGDVVVVATDALMTGFTGDFDSVIDCN (SEQ ID NO: 10); and has a length of 228 amino acids. Such a polytope can include NS3 T-cell epitopes designated NS3-1, NS3-2, NS3-3, NS3-4, NS3-5, NS3-6, NS3-7, NS3-9, NS3-10, NS3-11, NS3-12, and NS3-13 in FIG. 13B and FIGS. 15A-15N.

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1265-1279 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1309-1323 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1401-1415 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1402-1412 of the amino acid sequence designated "Consensus" in FIGS. 16A-16L, or a corresponding HCV NS3 amino acid sequence of any HCV genotype; and the HCV NS3 T-cell epitope can have a length of from 11 amino acids (aa) to 16 amino acids (e.g., 11 aa, 12 aa, 13 aa, 14 aa, 15 aa, or 16 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1429-1439 of the amino acid sequence designated "Consensus" in FIGS. 16A-16L, or a corresponding HCV NS3 amino acid sequence of any HCV genotype; and the HCV NS3 T-cell epitope can have a length of from 11 amino acids (aa) to 16 amino acids (e.g., 11 aa, 12 aa, 13 aa, 14 aa, 15 aa, or 16 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1450-1464 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1453-1467 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1577-1591 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1306-1314 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1387-1394 of the amino acid sequence designated "Consensus" in FIGS. 16A-16L, or a corresponding HCV NS3 amino acid sequence of any HCV genotype; and the HCV NS3 T-cell epitope can have a length of from 1 amino acids (aa) to 15 amino acids (e.g., 8 aa, 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1405-1413 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1450-1458 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1457-1465 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1610-1618 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

HCV NS2 T-cell Epitopes

In some cases, the heterologous polypeptide present in an E2 variant polypeptide of an E1/E2 heterodimer of the present disclosure includes one or more T-cell epitopes present in an HCV NS2 polypeptide. Examples of T-cell epitopes present in NS2 polypeptides are depicted in FIGS. 15A-15N, and FIG. 13A.

For example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 955-974 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 975-994 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 985-1004 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1015-1034 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1035-1054 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 924-933 of the amino acid sequence designated "Consensus" in FIGS. 16A-16L, or a corresponding HCV NS2 amino acid sequence of any HCV genotype; and the NS2 T cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 961-970 of the amino acid sequence designated "Consensus" in FIGS. 16A-16L, or a corresponding HCV NS2 amino acid sequence of any HCV genotype; and the NS2 T cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 989-997 of the amino acid sequence designated "Consensus" in FIGS. 16A-16L, or a corresponding HCV NS2 amino acid sequence of any HCV genotype; and the NS2 T cell epitope can have a length of from 9 amino acids (aa) to 15 amino acids (e.g., 9 aa, 10 aa, 11 aa, 12 aa, 13 aa, 14 aa, or 15 aa).

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 50 aa (e.g., from 10 aa to 25 aa, or from 25 aa to 50 aa) of amino acids 955-1004 of the amino acid sequence designated "Consensus" in FIGS. 16A-16L, or a corresponding HCV NS2 amino acid sequence of any HCV genotype; and has a length of from 10 amino acids (aa) to 25 aa, or from 25 aa to 50 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 955-1004 of the amino acid sequence designated "Consensus" in FIGS. 16A-16L, or a corresponding HCV NS2 amino acid sequence of any HCV genotype; and has a length of about 50 amino acids.

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 553 aa (e.g., from 10 aa to 25 aa, from 25 aa to 50 aa, from 50 aa to 100 aa, from 100 aa to 200 aa, from 200 aa to 300 aa, from 300 aa to 400 aa, from 400 aa to 500 aa, or from 500 aa to 553 aa) of amino acids 917-1469 of the amino acid sequence designated "Consensus" in FIGS. 16A-16L, or a corresponding HCV NS2 and NS3 amino acid sequence of any HCV genotype; and has a length of from 10 amino acids (aa) to 25 aa, from 25 aa to 50 aa, from 50 aa to 100 aa, from 100 aa to 200 aa, from 200 aa to 300 aa, from 300 aa to 400 aa, from 400 aa to 500 aa, or from 500 aa to 553 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 917-1469 of the amino acid sequence designated "Consensus" in FIGS. 16A-16L, or a corresponding HCV NS2 and NS3 amino acid sequence of any HCV genotype; and has a length of about 553 amino acids.

The heterologous polypeptide can comprise an amino acid sequence having at least about 20%, at least about 25%, at least about 30%, at least about 35%, at least about 40%, at least about 45%, at least about 50%, at least about 60%, at least about 0%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRDWAHNGLRDLAVAVEPV-VFSQMETKLITWGADT (SEQ ID NO: 11). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRDWAHNGLRDLAVAVEPV-VFSQMETKLITWGADT (SEQ ID NO:11); and has a length of from 50 amino acids to 60 amino acids (e.g., 50 aa, 51 aa, 52 aa, 53 aa, 54 aa, 55 aa, 56 aa, 57 aa, 58 aa, 59 aa, or 60 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRD-WAHNGLRDLAVAVEPVVFSQMETKLITWGADT (SEQ ID NO: 11); and has a length of 50 amino acids. Such a polytope can include NS2 T-cell epitopes designated NS2-1, NS2-2, NS2-3, NS2-7, and NS2-8 in FIG. 13A and FIGS. 15A-15N.

HCV NS4A T-cell Epitopes

In some cases, the heterologous polypeptide present in an E2 variant polypeptide of an E1/E2 heterodimer of the present disclosure includes one or more T-cell epitopes present in an HCV NS4A polypeptide. Examples of T-cell epitopes present in NS4A polypeptides are depicted in FIGS. 15A-15N and FIG. 13B.

The heterologous polypeptide can comprise an NS4A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1683-1692 of the amino acid sequence designated "Consensus" in FIGS. 16A-16L, or a corresponding HCV NS4A amino acid sequence of any HCV genotype; and the NS4A T-cell epitope can have a length of from 10 amino acids (aa) to 15 amino acids (e.g., 10 aa, 11 aa, 12 aa, 13 aa, 14 aa, or 15 aa).

HCV NS4B T-cell Epitopes

In some cases, the heterologous polypeptide present in an E2 variant polypeptide of an E1/E2 heterodimer of the present disclosure includes one or more T-cell epitopes present in an HCV NS4B polypeptide. Examples of T-cell epitopes present in NS4B polypeptides are depicted in FIGS. 15A-15N and FIG. 13B.

As one example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1790-1801 of the amino acid sequence designated "Consensus" in FIGS. 16A-16L, or a corresponding HCV NS4B amino acid sequence of any HCV genotype; and the NS4B T-cell epitope can have a length of from 12 amino acids (aa) to 20 amino acids (e.g., 12 aa, 13 aa, 14 aa, 15 aa, 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1792-1802 of the amino acid sequence designated "Consensus" in FIGS. 16A-16L, or a corresponding HCV NS4B amino acid sequence of any HCV genotype; and the NS4B T-cell epitope can have a length of from 11 amino acids (aa) to 20 amino acids (e.g., 11 aa, 12 aa, 13 aa, 14 aa, 15 aa, 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1898-1905 of the amino acid sequence designated "Consensus" in FIGS. 16A-16L, or a corresponding HCV NS4B amino acid sequence of any HCV genotype; and the NS4B T-cell epitope can have a length of from 8 amino acids (aa) to 15 amino acids (e.g., 8 aa, 9 aa, 10 aa, 11 aa, 12 aa, 13 aa, 14 aa, or 15 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1921-1935 of the amino acid sequence designated "Consensus" in FIGS. 16A-16L, or a corresponding HCV NS4B amino acid sequence of any HCV genotype; and the NS4B T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1922-1941 of the amino acid sequence designated "Consensus" in FIGS. 16A-16L, or a corresponding HCV NS4B amino acid sequence of any HCV genotype; and the NS4B T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1928-1947 of the amino acid sequence designated "Consensus" in FIGS. 16A-16L, or a corresponding HCV NS4B amino acid sequence of any HCV genotype; and the NS4B T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1868-1876 of the amino acid sequence designated "Consensus" in FIGS. 16A-16L, or a corresponding HCV NS4B amino acid sequence of any HCV genotype; and the NS4B T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1927-1942 of the amino acid sequence designated "Consensus" in FIGS. 16A-16L, or a corresponding HCV NS4B amino acid sequence of any HCV genotype; and the NS4B T-cell epitope can have a length of from 16 amino acids (aa) to 20 amino acids (e.g., 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1932-1940 of the amino acid sequence designated "Consensus" in FIGS. 16A-16L, or a corresponding HCV NS4B amino acid sequence of any HCV genotype; and the NS4B T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1948-1962 of the amino acid sequence designated "Consensus" in FIGS. 16A-16L, or a corresponding HCV NS4B amino acid sequence of any HCV genotype; and the NS4B T-cell epitope can have a length of from 15 amino acids (aa) to 20 amino acids (e.g., 15 aa, 16 aa, 17 aa, 18 aa, 19 aa, or 20 aa).

HCV NS5A T-cell Epitopes

In some cases, the heterologous polypeptide present in an E2 variant polypeptide of an E1/E2 heterodimer of the present disclosure includes one or more T-cell epitopes present in an HCV NS5A polypeptide. Examples of T-cell epitopes present in NS5A polypeptides are depicted in FIGS. 15A-15N and FIG. 13B.

As one example, the heterologous polypeptide can comprise an NS5A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2218-2232 of the amino acid sequence designated "Consensus" in FIGS. 16A-16L, or a corresponding HCV NS5A amino acid sequence of any HCV genotype; and the NS5A T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an NS5A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2309-2317 of the amino acid sequence designated "Consensus" in FIGS. 16A-16L, or a corresponding HCV NS5A amino acid sequence of any HCV genotype; and the NS5A T-cell epitope can have a length of from 9 amino acids (aa) to 15 amino acids (e.g., 9 aa, 10 aa, 11 aa, 12 aa, 13 aa, 14 aa, or 15 aa).

HCV NS5B T-cell Epitopes

In some cases, the heterologous polypeptide present in an E2 variant polypeptide of an E1/E2 heterodimer of the present disclosure includes one or more T-cell epitopes present in an HCV NS5B polypeptide. Examples of T-cell epitopes present in NS5B polypeptides are depicted in FIGS. 15A-15N and FIG. 13B.

As one example, the heterologous polypeptide can comprise an NS5B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2847-2851 of the amino acid sequence designated "Consensus" in FIGS. 16A-16L, or a corresponding HCV NS5B amino acid sequence of any HCV genotype; and the NS5B T-cell epitope can have a length of from 5 amino acids (aa) to 10 amino acids (e.g., 5 aa, 6 aa, 7 aa, 8 aa, 9 aa, or 10 aa).

As another example, the heterologous polypeptide can comprise an NS5B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2602-2610 of the amino acid sequence designated "Consensus" in FIGS. 16A-16L, or a corresponding HCV NS5B amino acid sequence of any HCV genotype; and the NS5B T-cell epitope can have a length of from 9 amino acids (aa) to 15 amino acids (e.g., 9 aa, 10 aa, 11 aa, 12 aa, 13 aa, 14 aa, or 15 aa).

HCV Core T-cell Epitopes

In some cases, the heterologous polypeptide present in an E2 variant polypeptide of an E1/E2 heterodimer of the present disclosure includes one or more T-cell epitopes present in an HCV core polypeptide. Examples of T-cell epitopes present in HCV Core polypeptides are depicted in FIGS. 15A-15N and FIG. 13A.

As one example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1-20 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 11-30 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 21-40 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 39-63 of the amino acid sequence designated "Consensus" in FIGS. 16A-16L, or a corresponding HCV core amino acid sequence of any HCV genotype; and the HCV core T-cell epitope can have a length of from 23 amino acids (aa) to 28 amino acids (e.g., 23 aa, 24 aa, 25 aa, 26 aa, 27 aa, or 28 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 47-70 of the amino acid sequence designated "Consensus" in FIGS. 16A-16L, or a corresponding HCV core amino acid sequence of any HCV genotype; and the HCV core T-cell epitope can have a length of from 24 amino acids (aa) to 29 amino acids (e.g., 24 aa, 25 aa, 26 aa, 27 aa, 28 aa, or 29 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 61-80 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 71-90 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 81-100 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 91-110 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 101-115 of the amino acid sequence designated "Consensus" in FIGS. 16A-16L, or a corresponding HCV core amino acid sequence of any HCV genotype; and the HCV core T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 111-130 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 125-139 of the amino acid sequence designated "Consensus" in FIGS. 16A-16L, or a corresponding HCV core amino acid sequence of any HCV genotype; and the HCV core T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 131-150 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 151-170 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 161-180 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 35-44 of the amino acid sequence designated "Consensus" in FIGS. 16A-16L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 43-51 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 51-59 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 129-137 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 131-140 of the amino acid sequence designated "Consensus" in FIGS. 16A-16L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 150-158 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 154-162 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 168-176 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 177-187 of the amino acid sequence designated "Consensus" in FIGS. 16A-16L, or a corresponding HCV core amino acid sequence of any HCV genotype; and the HCV core T-cell epitope can have a length of from 11 amino acids (aa) to 16 amino acids (e.g., 11 aa, 12 aa, 13 aa, 14 aa, 15 aa, or 16 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 178-187 of the amino acid sequence designated "Consensus" in FIGS. 16A-16L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 191 aa (e.g., from 10 aa to 25 aa, from 25 aa to 50 aa, from 50 aa to 75 aa, from 75 aa to 100 aa, from 100 aa to 150 aa, or from 150 aa to 191 aa) of amino acids 1-191 of the amino acid sequence designated "Consensus" in FIGS. 16A-16L, or a corresponding HCV core amino acid sequence of any HCV genotype; and has a length of from 10 amino acids (aa) to 25 aa, from 25 aa to 50 aa, from 50 aa to 100 aa, or from 100 aa to 150 aa, or from 150 aa to 191 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1-191 of the amino acid sequence designated "Consensus" in FIGS. 16A-16L, or a corresponding HCV core amino acid sequence of any HCV genotype; and has a length of about 191 amino acids.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQIVG-GVYLLPRRGPRLGVRATRKTS ERSQPRGRRQPIP-KARRPEGRTWAQPGYPWPLYGNEGCGWAGWLL-SPRGSRPS WGPTDPRRRSRNLGKVIDTLTCGFADLMGYIPLVGA-PLGGAARALAHGVRVLE DGVNYATGNLPG (SEQ ID NO:63); and has a length of from 171 amino acids (aa) to 180 aa (e.g., 171 aa, 172 aa, 173 aa, 174 aa, 175 aa, 176 aa, 177 aa, 178 aa, 179 aa, or 180 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPK-PQRKTKRNTNRRPQDVKFPGGGQIVGGVYLLPRRG-PRLGVRATRKTS ERSQPRGRRQPIPKARRPEGRT-WAQPGYPWPLYGNEGCGWAGWLLSPRGSRPS WGPTDPRRRSRNLGKVIDTLTCGFADLMGYIPLVGA-PLGGAARALAHGVRVLE DGVNYATGNLPG (SEQ ID NO:63); and has a length of 171 amino acids. Such a polytope can include core T-cell epitopes designated Core-1, Core-2, Core-3, Core-4, Core-5, Core-6, Core-7, Core-8, Core-9, Core-10, Core-11, Core-12, Core-13, Core-14, Core-16, Core-17, Core-18, Core-19, Core-20, Core-21, Core-22 in FIG. 13A and FIGS. 15A-15N.

HCV p7 T-cell Epitopes

In some cases, the heterologous polypeptide present in an E2 variant polypeptide of an E1/E2 heterodimer of the present disclosure includes one or more T-cell epitopes present in an HCV p7 polypeptide. Examples of T-cell epitopes present in HCV p7 polypeptides are depicted in FIGS. 15A-15N or FIG. 13A.

As another example, the heterologous polypeptide can comprise an HCV p7 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 803-811 of the amino acid sequence designated "Consensus" in FIGS. 16A-16L, or a corresponding HCV p7 amino acid sequence of any HCV genotype; and the HCV p7 T-cell epitope can have a length of from 9 amino acids (aa) to 15 amino acids (e.g., 9 aa, 10 aa, 11 aa, 12 aa, 13 aa, 14 aa, or 15 aa).

Polytopes Including HCV T-cell Epitopes from more than One HCV Polypeptide other than E1 and E2

As noted above, a heterologous polypeptide can include T-cell epitopes from more than one HCV polypeptide other than E1 and E2.

As one example, a heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: QASLLKVPYFVRVQGLLRICALARKMAG-GHYVQMAIIKLGALTGTYVYNALTP LRDWAHNGL-RDLAVAVEPVVFSQMETKLITWGADTAACGDI-INGLPVSARRGR EILLGPADGMVSKGWRLLAPITAYAQQTRGLLGCIIT-SLTGRDKNQVEGEVQIVS TAAQTFLATCINGVCWT-VYHGAGTRTIASPKGPVIQMYTNVDQDLVGW-PAPQG ARSLTPCTCGSSDLYLVTRHADVIPVRRRGDSRGSLL-SPRPISYLKGSAGGPLLCP AGHAVGIFRAAVCTRG-VAKAVDFIPVENLETTMRSPVFTDNSSPPAVPQSFQVA HLHAPTGSGKSTKVPAAYAAQGYKVLVLNPSVAATL-GFGAYMSKAHGIDPNIR TGVRTITTGSPITYSTYGK-FLADGGCSGGAYDIIICDECHSTDATSILGIGTVLDQA ETAGARLVVLATATPPGSVTVPHPNIEEVALSTTGEIP-FYGKAIPLEVIKGGRHLIF CHSKKKCDELAAKLVAL-GINAVAYYRGLDVSVIPTSGDVVVVATDALMTGFTG DFDSVIDCN (SEQ ID NO:12); and has a length of from 550 amino acids (aa) to 560 aa (e.g., 550 aa, 551 aa, 552 aa, 553 aa, 554 aa, 555 aa, 556 aa, 557 aa, 558 aa, 559 aa, or 560 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: QASLLKVPYFVRVQGLLRICALARKMAG-GHYVQMAIIKLGALTGTYVYNALTP LRDWAHNGL-RDLAVAVEPVVFSQMETKLITWGADTAACGDI-INGLPVSARRGR EILLGPADGMVSKGWRLLAPITAYAQQTRGLLGCIIT-SLTGRDKNQVEGEVQIVS TAAQTFLATCINGVCWT-VYHGAGTRTIASPKGPVIQMYTNVDQDLVGW-PAPQG ARSLTPCTCGSSDLYLVTRHADVIPVRRRGDSRGSLL-SPRPISYLKGSAGGPLLCP AGHAVGIFRAAVCTRG-VAKAVDFIPVENLETTMRSPVFTDNSSPPAVPQSFQVA HLHAPTGSGKSTKVPAAYAAQGYKVLVLNPSVAATL-GFGAYMSKAHGIDPNIR TGVRTITTGSPITYSTYGK-FLADGGCSGGAYDIIICDECHSTDATSILGIGTVLDQA ETAGARLVVLATATPPGSVTVPHPNIEEVALSTTGEIP-FYGKAIPLEVIKGGRHLIF CHSKKKCDELAAKLVAL-GINAVAYYRGLDVSVIPTSGDVVVVATDALMTGFTG DFDSVIDCN (SEQ ID NO: 12); and has a length of 553 amino acids. Such a polytope can include T-cell epitopes designated NS2-1, NS2-2, NS2-3, NS2-4, NS2-5, NS2-6, NS2-7, NS2-8, NS3-1, NS3-2, NS3-3, NS3-4, NS3-5, NS3-6, NS3-7, NS3-9, NS3-10, NS3-11, NS3-12, and NS3-13 in FIGS. 13A-13B and FIGS. 15A-15N. This polytope is also referred to as "TP553" (FIGS. 14A-14D). In order to prevent self cleavage of the TP553 polytope (amino acids 917-1469) (FIGS. 15E-G) at the NS2-NS3 junction that is mediated by the catalytic domain of the NS2 protease (amino acids 917-1040), the histidine at position 966 (H966), a critical residue for NS2 protease activity, is mutated to alanine (H966A) (FIG. 15E).

As another example, the heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 778 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 450 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 778 aa) the following amino acid sequence: LHAPTGSGKSTKVPAAYAAQGYKVLVLNPSVAATLG-FGAYMSKAHGIDPNIRTGVRTIT TGSPITYSTYGK-FLADGGCSGGAYDIIICDECHSTDATSILGIGTV-LDQAETAGARLVVLA TATPPGSVTVPHPNIEEVALSTTGEIPFYGKAIPLEVIK-GGRHLIFCHSKKKCDELAAKLV ALGINAVAYYRGLD-VSVIPTSGDVVVVATDALMTGFTGDFDSVID-CNTCVTQTVDFSLD PTFTIETTTLPQDAVSRTQRRGRTGRGKPGIYR-FVAPGERPSGMFDSSVLCECYDAGCA WYELTPAETT- VRLRAYMNTPGLPVCQDHLEFWEGVFTGLTHIDAHFLSQTKQSGENLP YLVAYQATVCARAQAPPPSWDQMWKCLIRLKPTLHGPTPLLYRLGAVQNEVTLTHPIT KYIMTCMSADLEVVTSTWVLVGGVLAALAAYCLSTGCVVIVGRIVLSGKPAIIPDREVL YREFDEMEECSQHLPYIEQGMMLAEQFKQKALGLLQTASRQAEVIAPAVQTNWQKLEA FWAKHMWNFISGIQYLAGLSTLPGNPAIASLMAFTAAVTSPLTTSQTLLFNILGGWVAA QLAAPGAATAFVGAGLAGAAIGSVGLGKVLVDILAGYGAGVAGALVAFKIMSGEVPST EDLVNLLPAILSPGALVVGVVCAAILRRHVGPGEGAVQWMNRLIAFASRGNHVSPTHY VPESDAAARVTAILSSLTVTQLLRRLHQWISSECTTPCSGSWLRDIWDWICEVLSDFKTW LKAKLMPQLPG (SEQ ID NO:64). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 778 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 450 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 778 aa) of the following amino acid sequence: LHAPTGSGKSTKVPAAYAAQGYKVLVLNPSVAATLGFGAYMSKAHGIDPNIRTGVRTIT TGSPITYSTYGKFLADGGCSGGAYDIIICDECHSTDATSILGIGTVLDQAETAGARLVVLA TATPPGSVTVPHPNIEEVALSTTGEIPFYGKAIPLEVIKGGRHLIFCHSKKKCDELAAKLV ALGINAVAYYRGLDVSVIPTSGDVVVVATDALMTGFTGDFDSVIDCNTCVTQTVDFSLD PTFTIETTTLPQDAVSRTQRRGRTGRGKPGIYRFVAPGERPSGMFDSSVLCECYDAGCA WYELTPAETTVRLRAYMNTPGLPVCQDHLEFWEGVFTGLTHIDAHFLSQTKQSGENLP YLVAYQATVCARAQAPPPSWDQMWKCLIRLKPTLHGPTPLLYRLGAVQNEVTLTHPIT KYIMTCMSADLEVVTSTWVLVGGVLAALAAYCLSTGCVVIVGRIVLSGKPAIIPDREVL YREFDEMEECSQHLPYIEQGMMLAEQFKQKALGLLQTASRQAEVIAPAVQTNWQKLEA FWAKHMWNFISGIQYLAGLSTLPGNPAIASLMAFTAAVTSPLTTSQTLLFNILGGWVAA QLAAPGAATAFVGAGLAGAAIGSVGLGKVLVDILAGYGAGVAGALVAFKIMSGEVPST EDLVNLLPAILSPGALVVGVVCAAILRRHVGPGEGAVQWMNRLIAFASRGNHVSPTHY VPESDAAARVTAILSSLTVTQLLRRLHQWISSECTTPCSGSWLRDIWDWICEVLSDFKTW LKAKLMPQLPG (SEQ ID NO:64); and has a length of from 25 amino acids (aa) to 50 aa, from 50 aa to 100 aa, from 100 aa to 200 aa, from 200 aa to 300 aa, from 300 aa to 400 aa, from 400 aa to 500 aa, from 500 aa to 600 aa, from 600 aa to 700 aa, or from 700 aa to 778 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGKSTKVPAAYAAQGYKVLVLNPSVAATLGFGAYMSKAHGIDPNIRTGVRTIT TGSPITYSTYGKFLADGGCSGGAYDIIICDECHSTDATSILGIGTVLDQAETAGARLVVLA TATPPGSVTVPHPNIEEVALSTTGEIPFYGKAIPLEVIKGGRHLIFCHSKKKCDELAAKLV ALGINAVAYYRGLDVSVIPTSGDVVVVATDALMTGFTGDFDSVIDCNTCVTQTVDFSLD PTFTIETTTLPQDAVSRTQRRGRTGRGKPGIYRFVAPGERPSGMFDSSVLCECYDAGCA WYELTPAETTVRLRAYMNTPGLPVCQDHLEFWEGVFTGLTHIDAHFLSQTKQSGENLP YLVAYQATVCARAQAPPPSWDQMWKCLIRLKPTLHGPTPLLYRLGAVQNEVTLTHPIT KYIMTCMSADLEVVTSTWVLVGGVLAALAAYCLSTGCVVIVGRIVLSGKPAIIPDREVL YREFDEMEECSQHLPYIEQGMMLAEQFKQKALGLLQTASRQAEVIAPAVQTNWQKLEA FWAKHMWNFISGIQYLAGLSTLPGNPAIASLMAFTAAVTSPLTTSQTLLFNILGGWVAA QLAAPGAATAFVGAGLAGAAIGSVGLGKVLVDILAGYGAGVAGALVAFKIMSGEVPST EDLVNLLPAILSPGALVVGVVCAAILRRHVGPGEGAVQWMNRLIAFASRGNHVSPTHY VPESDAAARVTAILSSLTVTQLLRRLHQWISSECTTPCSGSWLRDIWDWICEVLSDFKTW LKAKLMPQLPG (SEQ ID NO:64); and has a length of 778 amino acids. Such a polytope can include T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS2-14, NS4a-1, NS4b-1, NS4b-2, NS4b-3, NS4b-4, NS4b-5, NS4b-6, NS4b-7, NS4b-8, NS4b-9, and NS4b-10 in FIG. 13B and FIGS. 15A-15N.

As another example, the heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 1985 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 500 aa, from 500 aa to 750 aa, from 750 aa to 1000 aa, from 1000 aa to 1500 aa, or from 1500 aa to 1985 aa) of the following amino acid sequence:

(SEQ ID NO: 13)
APITAYAQQTRGLLGCIITSLTGRDKNQVEGEVQIVSTAAQTFLATCING

VCWTVYHGAGTRTIASPKGPVIQMYTNVDQDLVGWPAPQGARSLTPCTCG

SSDLYLVTRHADVIPVRRRGDSRGSLLSPRPISYLKGSAGGPLLCPAGHA

VGIFRAAVCTRGVAKAVDFIPVENLETTMRSPVFTDNSSPPAVPQSFQVA

HLHAPTGSGKSTKVPAAYAAQGYKVLVLNPSVAATLGFGAYMSKAHGIDP

NIRTGVRTITTGSPITYSTYGKFLADGGCSGGAYDIIICDECHSTDATSI

LGIGTVLDQAETAGARLVVLATATPPGSVTVPHPNIEEVALSTTGEIPFY

GKAIPLEVIKGGRHLIFCHSKKKCDELAAKLVALGINAVAYYRGLDVSVI

-continued

PTSGDVVVVATDALMTGFTGDFDSVIDCNTCVTQTVDFSLDPTFTIETTT

LPQDAVSRTQRRGRTGRGKPGIYRFVAPGERPSGMFDSSVLCECYDAGCA

WYELTPAETTVRLRAYMNTPGLPVCQDHLEFWEGVFTGLTHIDAHFLSQT

KQSGENLPYLVAYQATVCARAQAPPPSWDQMWKCLIRLKPTLHGPTPLLY

RLGAVQNEVTLTHPITKYIMTCMSADLEVVTSTWVLVGGVLAALAAYCLS

TGCVVIVGRIVLSGKPAIIPDREVLYREFDEMEECSQHLPYIEQGMMLAE

QFKQKALGLLQTASRQAEVIAPAVQTNWQKLEAFWAKHMWNFISGIQYLA

GLSTLPGNPAIASLMAFTAAVTSPLTTSQTLLFNILGGWVAAQLAAPGAA

TAFVGAGLAGAAIGSVGLGKVLVDILAGYGAGVAGALVAFKIMSGEVPST

EDLVNLLPAILSPGALVVGVVCAAILRRHVGPGEGAVQWMNRLIAFASRG

NHVSPTHYVPESDAAARVTAILSSLTVTQLLRRLHQWISSECTTPCSGSW

LRDIWDWICEVLSDFKTWLKAKLMPQLPGIPFVSCQRGYRGVWRGDGIMH

TRCHCGAEITGHVKNGTMRIVGPRTCRNMWSGTFPINAYTTGPCTPLPAP

NYTFALWRVSAEEYVEIRQVGDFHYVTGMTTDNLKCPCQVPSPEFFTELD

GVRLHRFAPPCKPLLREEVSFRVGLHEYPVGSQLPCEPEPDVAVLTSMLT

DPSHITAEAAGRRLARGSPPSVASSSASQLSAPSLKATCTANHDSPDAEL

IEANLLWRQEMGGNITRVESENKVVILDSFDPLVAEEDEREISVPAEILR

KSRRFAPALPIWARPDYNPPLLETWKKPDYEPPVVHGCPLPPPQSPPVPP

PRKKRTVVLTESTVSTALAELATKSFGSSSTSGITGDNTTTSSEPAPSGC

PPDSDAESYSSMPPLEGEPGDPDLSDGSWSTVSSEADTEDVVCCSMSYSW

TGALVTPCAAEEQKLPINALSNSLLRHHNLVYSTTSRSACQRQKKVTFDR

LQVLDSHYQDVLKEVKAAASKVKANLLSVEEACSLTPPHSAKSKFGYGAK

DVRCHARKAVNHINSVWKDLLEDSVTPIDTTIMAKNEVFCVQPEKGGRKP

ARLIVFPDLGVRVCEKMALYDVVSKLPLAVMGSSYGFQYSPGQRVEFLVQ

AWKSKKTPMGFSYDTRCFDSTVTESDIRTEEAIYQCCDLDPQARVAIKSL

TERLYVGGPLTNSRGENCGYRRCRASGVLTTSCGNTLTCYIKARAACRAA

GLQDCTMLVCGNNLVVICESAGVQEDAASLRAFTEAMTRYSAPPGDPPQP

EYDLELITSCSSNVSVAHDGAGKRVYYLTRDPTTPLARAAWETARHTPVN

SWLGNIIMFAPTLWARMILMTHFFSVLIARDQLEQALDCEIYGACYSIEP

LDLPPIIQRLHGLSAFSLHSYSPGEINRVAACLRKLGVPPLRAWRHRARS

VRARLLSRGGRAAICGKYLFNWAVRTKLKLTPIAAAGQLDLSGWFTAGYS

GGDIYHSVSHARPRWFWFCLLLLAAGVGIYLLPNR.

In some cases, the heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: APITAYAQQTRGLLGCIITSLTGRDKNQVEG-EVQIVSTAAQTFLATCINGVCWTV YHGAGTRTIASP-KGPVIQMYTNVDQDLVGWPAPQGARSLTPCTCGSS-DLYLVT RHADVIPVRRRGDSRGSLLSPRPISYLKGS AGGPLLCPAGHAVGIFRAAVCTRGV AKAVDFIPVEN-LETTMRSPVFTDNSSPPAVPQSFQVAHLHAPTGSGK-STKVPAA YAAQGYKVLVLNPSVAATLGFGAYM-SKAHGIDPNIRTGVRTITTGSPITYSTYG
KFLADGGCSGGAYDIIICDECHSTDATSILGIGTV-LDQAETAGARLVVLATATPP GSVTVPHPNIEEVALST-TGEIPFYGKAIPLEVIKGGRHLIFCHSKKKCDE-
LAAKLV
ALGINAVAYYRGLDVSVIPTSGDVVVVATDALMTG-FTGDFDSVIDCNTCVTQT VDFSLDPTFTIETTTLPQ-DAVSRTQRRGRTGRGKPGIYRFVAPGERPSGMFDSSV LCECYDAGCAWYELTPAETTVRLRAYMNTPGLPVC-QDHLEFWEGVFTGLTHID AHFLSQTKQSGENLPYL-VAYQATVCARAQAPPPSWDQMWKCLIRLKPTLHGPT PLLYRLGAVQNEVTLTHPITKYIMTCMSADLEV-VTSTWVLVGGVLAALAAYCL STGCVVIVGRIVLS-GKPAIIPDREVLYREFDEMEECSQHLPYIEQGMM-
LAEQFKQ
KALGLLQTASRQAEVIAPAVQTNWQKLEAFWAKHM-WNFISGIQYLAGLSTLPG NPAIASLMA-FTAAVTSPLTTSQTLLFNILGGWVAAQLAAP-GAATAFVGAGLAGA
AIGSVGLGKVLVDILAGYGAGVAGALVAFKIMS-GEVPSTEDLVNLLPAILSPGAL VVGVVCAAILR-RHVGPGEGAVQWMNRLIAFASRGNHVSPTHYVPES-DAAARV
TAILSSLTVTQLLRRLHQWISSECTTPCSGSWLRDI-WDWICEVLSDFKTWLKAKL MPQLPGIPFVSCQR-GYRGVWRGDGIMHTRCHCGAEITGHVKNGTM-RIVGPRTC RNMWSGTFPINAYTTGPCTPLPAPNYTFALWRV-SAEEYVEIRQVGDFHYVTGM TTDNLKCPCQVPSP-EFFTELDGVRLHRFAPPCKPLLREEVSFRVGL-HEYPVGSQL PCEPEPDVAVLTSMLTDPSHITAEAAGRRLARGSPPS-VASSSASQLSAPSLKATCT ANHDSPDAELIEANLL-WRQEMGGNITRVESENKVVILDSFDPLVAEEDER-EISVP AEILRKSRRFAPALPIWARPDYNPPLLETWKKPDYEP-PVVHGCPLPPPQSPPVPPP RKKRTVVLTESTVSTA-LAELATKSFGSSSTSGITGDNTTTSSEPAPSGCPPDS-DAE SYSSMPPLEGEPGDPDLSDGSWSTVSSEADTEDV-VCCSMSYSWTGALVTPCAAE EQKLPINALSNSLL-RHHNLVYSTTSRSACQRQKKVTFDRLQVLDSHYQD-VLKEV KAAASKVKANLLSVEEACSLTPPHSAKSKFGY-GAKDVRCHARKAVNHINSVW KDLLEDSVTPIDTTI-MAKNEVFCVQPEKGGRKPARLIVFPDLGVRVCEK-MALYD VVSKLPLAVMGSSYGFQYSPGQRVEFLVQAWKSKK-TPMGFSYDTRCFDSTVTE SDIRTEEAIYQCCDLD-PQARVAIKSLTERLYVGGPLTNSRGENCGYRRCRAS-GVL TTSCGNTLTCYIKARAACRAAGLQDCTMLVCG NNLVVICESAGVQEDAASLRA FTEAMTRYSAPPGDP-PQPEYDLELITSCSSNVSVAHDGAGKRVYYLTRDPTT-PLA RAAWETARHTPVNSWLGNIIMFAPTLWARM-ILMTHFFSVLIARDQLEQALDCEI YGACYSIEPLDLPPIIQRLHGLSAFSLHSYSPGEIN-RVAACLRKLGVPPLRAWRHR ARSVRARLLSRG-GRAAICGKYLFNWAVRTKLKLTPIAAAGQLDLSGW-FTAGYS GGDIYHSVSHARPRWFWFCLLLLAAGVGIYLLPNR (SEQ ID NO:13); and has a length of 1985 amino acids. Such a polytope can include T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10, NS5a-1, NS5a-2, NS5b-1, NS5b-2 in FIGS. 13A-13B and FIGS. 15A-15N.

Additional T-cell Epitopes As discussed above, an E1/E2 a heterodimeric polypeptide of the present disclosure includes: a) an HCV E2 polypeptide; and b) a variant HCV E1 polypeptide comprising: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide comprises one or more T cell epitopes present in: a) cholera toxin; and/or b) tetanus toxin; and/or c) diphtheria toxin; and/or d) a meningococcal outer membrane protein.

Thus, in some cases, a variant HCV E1 polypeptide of an E1/E2 heterodimer of the present disclosure includes: a) an HCV E1 polypeptide; and b) a heterologous polypeptide that comprises one or more T-cell epitopes, where the one or more T-cell epitopes are T-cell epitopes present in: i) one or more of an HCV NS3 polypeptide, an HCV NS2 polypeptide, an HCV NS4A polypeptide, an HCV NS4B polypeptide, an HCV NS5A polypeptide, an HCV NS5B polypeptide, an HCV core polypeptide, and an HCV p7 polypeptide; and ii) one or more of cholera toxin or toxoid, tetanus toxin or toxoid, diphtheria toxin or toxoid, and a meningococcal outer membrane protein.

A T helper tetanus toxin epitope or other bacterial T-cell epitope could be fused (e.g., by recombinant expression) or chemically conjugated to the HCV polytope/E2 fusion protein and/or to the HCV polytope E1 fusion protein of an E1/E2 heterodimer of the present disclosure to further enhance both T and B cell responses to both the HCV polytope and E1/E2 moieties. Alternatively, the whole or part of the detoxified toxin ("toxoid") could be fused (e.g., by recombinant expression) or chemically conjugated to the HCV polytope/E1E2 protein, wherein specific amino acids of the toxins are mutated to render the toxins inactive, thereby generating toxoids. Methods of generating toxoids are well known in the art. Examples of bacterial epitopes include the use of diphtheria toxoid, meningococcal outer membrane protein, or mutant diphtheria protein CRM197 (see, e.g.: www(dot)medscape(dot)com/viewarticle/431127)

In some cases, a suitable tetanus toxoid polypeptide comprises the amino acid sequence QYIKANSKFIGIFE (SEQ ID NO: 14). In some cases, a suitable tetanus toxoid polypeptide comprises the amino acid sequence QYIKANSKFIGITE (SEQ ID NO:65).

In some cases, a heterologous polypeptide can comprise cholera toxin (or toxoid) epitope. In some cases, a suitable heterologous polypeptide comprising a cholera toxoid epitope comprises a fragment of cholera toxin-B subunit (CT-B), e.g., a fragment of from 5 amino acids to 25 amino acids, or from 25 amino acids to 50 amino acids, of the following amino acid sequence: MIKLKFGVFF TVLLSSAYAH GTPQNITDLC AEYHNTQIHT LNDKIFSYTE SLAGKREMAI ITFKNGATFQ VEVPGSQHID SQKKAIERMK DTLRIAYLTE AKVEKLCVWN NKTPHAIAAI SMAN (SEQ ID NO:15). In some cases, a suitable heterologous polypeptide comprising a cholera toxoid epitope comprises the following amino acid sequence: SLAGKREMAIITFKNGATFQVEVPG (SEQ ID NO:29).

In some cases, a heterologous polypeptide can comprise a tetanus toxin (or toxoid) T-cell epitope. In some cases, a suitable heterologous polypeptide comprising a tetanus toxin T-cell epitope comprises the amino acid sequence: ILMQYIKANSKFIGI (SEQ ID NO:16); and has a length of from 15 amino acids to 20 amino acids. In some cases, a suitable heterologous polypeptide comprising a tetanus toxin T-cell epitope comprises the amino acid sequence: VNNESSE (SEQ ID NO: 17). In some cases, a suitable heterologous polypeptide comprising a tetanus toxin T-cell epitope comprises the amino acid sequence: PGINGKAIHLVNNESSE (SEQ ID NO: 18). In some cases, a suitable heterologous polypeptide comprising a tetanus toxin T-cell epitope comprises the amino acid sequence: PNRDIL (SEQ ID NO: 19). In some cases, a suitable heterologous polypeptide comprising a tetanus toxin T-cell epitope comprises the amino acid sequence: FIGITEL (SEQ ID NO:20). In some cases, a suitable tetanus toxin T-cell epitope comprises the amino acid sequence: SYFPSV (SEQ ID NO:21). In some cases, a suitable heterologous polypeptide comprising a tetanus toxin T-cell epitope comprises the amino acid sequence: NSVDDALINSTKIYSYFPSV (SEQ ID NO:22). In some cases, a suitable heterologous polypeptide comprising a tetanus toxin T-cell epitope comprises the amino acid sequence: IDKISDVSTIVPYIGPALNI (SEQ ID NO:23).

In some cases, a heterologous polypeptide can comprise a diphtheria toxin T-cell epitope In some cases, a suitable heterologous polypeptide comprising a diphtheria toxin T-cell epitope comprises the amino acid sequence: QSIALSSLMVAQAIP (SEQ ID NO:24); and has a length of from 15 amino acids to 20 amino acids. In some cases, a suitable heterologous polypeptide comprising a diphtheria toxin T-cell epitope comprises the amino acid sequence: PVFAGANYAAWAVNVAQVI (SEQ ID NO:25). In some cases, a suitable heterologous polypeptide comprising a diphtheria toxin T-cell epitope comprises the amino acid sequence: VHHNTEEIVAQSIALSSLMV (SEQ ID NO:26). In some cases, a suitable heterologous polypeptide comprising a diphtheria toxin T-cell epitope comprises the amino acid sequence: QSIALSSLMVAQAIPLVGEL (SEQ ID NO:66). In some cases, a suitable heterologous polypeptide comprising a diphtheria toxin T-cell epitope comprises the amino acid sequence: VDIGFAAYNFVESIINLFQV (SEQ ID NO:67). In some cases, a suitable heterologous polypeptide comprising a diphtheria toxin T-cell epitope comprises the amino acid sequence: QGESGHDIKITAENTPLPIA (SEQ ID NO:68). In some cases, a suitable heterologous polypeptide comprising a diphtheria toxin T-cell epitope comprises the amino acid sequence: GVLLPTIPGKLDVNKSKTHI (SEQ ID NO:69). In some cases, a suitable heterologous polypeptide comprising a diphtheria toxin T-cell epitope comprises the amino acid sequence of CRM197 (see, e.g., Giannini et al. (1984) Nucl. Acids. Res. 12:4063). The amino acid sequence of CRM197 is provided above.

In some cases, a heterologous polypeptide can comprise a tetanus toxin T-cell epitope and a diphtheria toxin T-cell epitope. In some of these cases, the heterologous polypeptide can comprise the amino acid sequence: IMQYIKANSKFIGIQSIALSSLMVAQ (SEQ ID NO:28); and can have a length of from 26 amino acids to 30 amino acids.

Additional Polypeptides

In any of the above-described embodiments, one or both of the polypeptide chains of the E1/E2 heterodimer can include one or more additional polypeptides. For example, in some cases, the variant E1 polypeptide or the variant E2 polypeptide can include an Ig Fc polypeptide at the C-terminus of the variant E1 polypeptide or the variant E2 polypeptide. Ig Fc polypeptides are known in the art, and are described elsewhere herein.

II. Variant E2 Polypeptides

The present disclosure provides a variant HCV E2 polypeptide that comprises: a) an HCV E2 polypeptide; and b) a heterologous polypeptide that comprises one or more T-cell epitopes (e.g., one or more T cell epitopes present in an HCV polypeptide other than an HCV E1 polypeptide or an HCV E2 polypeptide). The heterologous polypeptide is also referred to as a "polytope." A variant E2 polypeptide of the present disclosure is useful for inclusion in an E1/E2 heterodimer of the present disclosure.

The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein. In some cases, a variant HCV E2 polypeptide of the present disclosure includes: a) an HCV E2 polypeptide; and b) a heterologous polypeptide that comprises one or more T-cell epitopes, where the one or more T-cell epitopes are T-cell epitopes present in: i) one or more of an HCV NS3 polypeptide, an HCV NS2 polypeptide, an HCV NS4A polypeptide, an HCV NS4B polypeptide, an HCV NS5A polypeptide, an HCV NS5B polypeptide, an HCV core polypeptide, and an HCV p7 polypeptide; and ii) one or more of cholera toxin or toxoid, tetanus toxin or toxoid, diphtheria toxin or toxoid, and a meningococcal outer membrane protein.

In some cases, the variant HCV E2 polypeptide comprises, in order from N-terminus to C-terminus: i) an HCV E2 polypeptide; and ii) a heterologous polypeptide comprising one or more T cell epitopes. In some cases, the variant HCV E2 polypeptide comprises, in order from N-terminus to C-terminus: i) a heterologous polypeptide comprising one or more T cell epitopes; and ii) an HCV E2 polypeptide.

E2

An E2 polypeptide suitable for inclusion in a variant E2 polypeptide of the present disclosure can have a length of from about 200 amino acids (aa) to about 250 aa, from about 250 aa to about 275 aa, from about 275 aa to about 300 aa, from about 300 aa to about 325 aa, from about 325 aa to about 350 aa, or from about 350 aa to about 365 aa. The E2 polypeptide can be a full-length HCV E2 polypeptide. The E2 polypeptide can be an HCV E2 ectodomain polypeptide.

In FIGS. 1A-AC, the amino acid sequence of E2 is amino acid 384 to amino acid 746. In FIGS. 2A-2B, the amino acid sequence of E2 is amino acid 384 to amino acid 751. In FIGS. 3A-3C, the amino acid sequence of E2 is amino acid 385 to amino acid 754. In FIGS. 4A-4B, the amino acid sequence of E2 is amino acid 384 to amino acid 750. As used herein, an "E2 polypeptide" includes a precursor E2 protein, including the signal sequence; includes a mature E2 polypeptide which lacks this sequence; and includes an E2 polypeptide with a heterologous signal sequence. An E2 polypeptide can include a C-terminal membrane anchor sequence which occurs at approximately amino acid positions 715-730 and may extend as far as approximately amino acid residue 746 (see, Lin et al., J. Virol. (1994) 68:5063-5073).

In some cases, a E2 polypeptide suitable for inclusion in a variant E2 polypeptide of the present disclosure lacks a portion of its C-terminal region, e.g., from about amino acid 715 to the C-terminus; from about amino acid 625 to the C-terminus; from about amino acid 661 to the C-terminus; from about amino acid 655 to the C-terminus; from about amino acid 500 to the C-terminus, where the amino acid numbering is with reference to the numbering in FIGS. 1A-1C. See, e.g., U.S. Pat. No. 6,521,423.

An E2 polypeptide suitable for inclusion in a variant E2 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIGS. 1A-1C, FIGS. 2A-2C, FIGS. 3A-3C, or FIGS. 4A-4B.

An E2 polypeptide suitable for inclusion in a variant E2 polypeptide of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIGS. 1A-1C. For example, an E2 polypeptide of genotype 1 can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence depicted in FIGS. 1A-1C. For example, an E2 polypeptide of genotype 1A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence identified as 1A and depicted in FIGS. 1A-1C. For example, an E2 polypeptide of genotype 1B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence identified as 1B and depicted in FIGS. 1A-1C. For example, an E2 polypeptide of genotype 1C can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence identified as 1C and depicted in FIGS. 1A-1C.

An E2 polypeptide suitable for inclusion in a variant E2 polypeptide of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIGS. 2A-2C. For example, an E2 polypeptide can comprise an amino acid sequence having having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence depicted in FIGS. 2A-2C. For example, an E2 polypeptide of genotype 2A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-751 of the "consensus" amino acid sequence depicted in FIGS. 2A-2C. For example, an E2 polypeptide of genotype 2B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-751 of the "consensus" amino acid sequence depicted in FIGS. 2A-2C.

An E2 polypeptide suitable for inclusion in a variant E2 polypeptide of an E1/E2 heterodimer of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIGS. 3A-3C. For example, an E2 polypeptide of genotype 3 can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of an amino acid sequence depicted in FIGS. 3A-3C. For example, an E2 polypeptide of genotype 3A can comprise an amino acid sequence having having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of an amino acid sequence identified as 3A and depicted in FIGS. 3A-3C. For example, an E2 polypeptide of genotype 3B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of the amino acid sequence identified as 3B and depicted in FIGS. 3A-3C. For example, an E2 polypeptide of genotype 3K can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of the amino acid sequence identified as 3K and depicted in FIGS. 3A-3C.

An E2 polypeptide suitable for inclusion in a variant E2 polypeptide of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the amino acid sequence of the E2 polypeptide depicted in FIGS. 4A-4B. For example, an E2 polypeptide of genotype 7A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-750 of the amino acid sequence depicted in FIGS. 4A-4B.

Heterologous Polypeptide

The heterologous polypeptide present in an E2 variant polypeptide of the present disclosure includes one or more T-cell epitopes.

In some cases, the heterologous polypeptide comprises 1, 2, 3, 4, 5, 6, 7, 8, 9, or 10, or more than 10 (e.g., from 10 to 15, from 15 to 20, from 20 to 25, or from 25 to 30, or more than 30), T cell epitopes. T-cell epitopes are epitopes that, when presented with a major histocompatibility complex (MHC) (e.g., a human leukocyte antigen (HLA)) Class I or MHC Class II molecule, are recognized and bound by a T-cell receptor (TCR) present on a T cell surface. T-cell epitopes include epitopes recognized by cytotoxic T cells (e.g., $CD8^+$ T cells), and epitopes recognized by helper T cells (e.g., $CD4^+$ T cells).

The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein. Other examples of strong T helper epitopes are diphtheria toxoid, tetanus toxoid, meningococcal outer membrane protein, or mutant diphtheria protein CRM197 (see, e.g.: www(dot)medscape(dot)com/viewarticle/431127).

In some cases, the heterologous polypeptide comprises a single T-cell epitope. In some cases, the heterologous polypeptide comprises a single HCV-NS3 T-cell epitope. In some cases, the heterologous polypeptide comprises 2 or more T-cell epitopes. In some cases, the heterologous polypeptide comprises 2 or more HCV-NS3 T-cell epitopes. In some cases, the heterologous polypeptide comprises 3 or more HCV-NS3 T-cell epitopes. In some cases, the heterologous polypeptide comprises 4 or more HCV-NS3 T-cell epitopes. In some cases, the heterologous polypeptide comprises a single HCV-NS3 CD4$^+$ T-cell epitope. In some cases, the heterologous polypeptide comprises 2 or more HCV-NS3 CD4$^+$ T-cell epitopes. In some cases, the heterologous polypeptide comprises one or more HCV CD8$^+$ T cell epitopes. In some cases, the heterologous polypeptide comprises a single HCV-NS3 CD8$^+$ T-cell epitope. In some cases, the heterologous polypeptide comprises 2 or more HCV-NS3 CD8$^+$ T-cell epitopes. In some cases, the heterologous polypeptide comprises at least one HCV CD4$^+$ T cell epitope and at least one HCV CD8$^+$ T cell epitope. In some cases, the heterologous polypeptide comprises at least one HCV-NS3 CD4$^+$ T cell epitope and at least one HCV-NS3 CD8$^+$ T cell epitope. In some cases, heterologous polypeptide comprises 2 or more HCV-NS3 CD4$^+$ T-cell epitopes and 2 or more HCV-NS3 CD8$^+$ T-cell epitopes. In some cases, the heterologous polypeptide comprises 2, 3, 4, or 5 HCV-NS3 CD4$^+$ T-cell epitopes and 2, 3, 4, or 5 HCV-NS3 CD8$^+$ T-cell epitopes.

In some cases, the heterologous polypeptide comprises a single T-cell epitope. In some cases, the heterologous polypeptide comprises a single HCV-NS2 T-cell epitope. In some cases, the heterologous polypeptide comprises 2 or more T-cell epitopes. In some cases, the heterologous polypeptide comprises 2 or more HCV-NS2 T-cell epitopes. In some cases, the heterologous polypeptide comprises 3 or more HCV-NS2 T-cell epitopes. In some cases, the heterologous polypeptide comprises 4 or more HCV-NS2 T-cell epitopes. In some cases, the heterologous polypeptide comprises a single HCV-NS2 CD4$^+$ T-cell epitope. In some cases, the heterologous polypeptide comprises 2 or more HCV-NS2 CD4$^+$ T-cell epitopes. In some cases, the heterologous polypeptide comprises one or more HCV CD8$^+$ T cell epitopes. In some cases, the heterologous polypeptide comprises a single HCV-NS2 CD8$^+$ T-cell epitope. In some cases, the heterologous polypeptide comprises 2 or more HCV-NS2 CD8$^+$ T-cell epitopes. In some cases, the heterologous polypeptide comprises at least one HCV CD4$^+$ T cell epitope and at least one HCV CD8$^+$ T cell epitope. In some cases, the heterologous polypeptide comprises at least one HCV-NS2 CD4$^+$ T cell epitope and at least one HCV-NS2 CD8$^+$ T cell epitope. In some cases, heterologous polypeptide comprises 2 or more HCV-NS2 CD4$^+$ T-cell epitopes and 2 or more HCV-NS2 CD8$^+$ T-cell epitopes. In some cases, the heterologous polypeptide comprises 2, 3, 4, or 5 HCV-NS2 CD4$^+$ T-cell epitopes and 2, 3, 4, or 5 HCV-NS2 CD8$^+$ T-cell epitopes.

In some cases, the heterologous polypeptide comprises a single T-cell epitope. In some cases, the heterologous polypeptide comprises a single HCV-NS4A T-cell epitope. In some cases, the heterologous polypeptide comprises 2 or more T-cell epitopes. In some cases, the heterologous polypeptide comprises 2 or more HCV-NS4A T-cell epitopes. In some cases, the heterologous polypeptide comprises 3 or more HCV-NS4A T-cell epitopes. In some cases, the heterologous polypeptide comprises 4 or more HCV-NS4A T-cell epitopes. In some cases, the heterologous polypeptide comprises a single HCV-NS4A CD4$^+$ T-cell epitope. In some cases, the heterologous polypeptide comprises 2 or more HCV-NS4A CD4$^+$ T-cell epitopes. In some cases, the heterologous polypeptide comprises one or more HCV CD8$^+$ T cell epitopes. In some cases, the heterologous polypeptide comprises a single HCV-NS4A CD8$^+$ T-cell epitope. In some cases, the heterologous polypeptide comprises 2 or more HCV-NS4A CD8$^+$ T-cell epitopes. In some cases, the heterologous polypeptide comprises at least one HCV CD4$^+$ T cell epitope and at least one HCV CD8$^+$ T cell epitope. In some cases, the heterologous polypeptide comprises at least one HCV-NS4A CD4$^+$ T cell epitope and at least one HCV-NS4A CD8$^+$ T cell epitope. In some cases, heterologous polypeptide comprises 2 or more HCV-NS4A CD4$^+$ T-cell epitopes and 2 or more HCV-NS4A CD8$^+$ T-cell epitopes. In some cases, the heterologous polypeptide comprises 2, 3, 4, or 5 HCV-NS4A CD4$^+$ T-cell epitopes and 2, 3, 4, or 5 HCV-NS4A CD8$^+$ T-cell epitopes.

In some cases, the heterologous polypeptide comprises a single T-cell epitope. In some cases, the heterologous polypeptide comprises a single HCV-NS5A T-cell epitope. In some cases, the heterologous polypeptide comprises 2 or more T-cell epitopes. In some cases, the heterologous polypeptide comprises 2 or more HCV-NS5A T-cell epitopes. In some cases, the heterologous polypeptide comprises 3 or more HCV-NS5A T-cell epitopes. In some cases, the heterologous polypeptide comprises 4 or more HCV-NS5A T-cell epitopes. In some cases, the heterologous polypeptide comprises a single HCV-NS5A CD4$^+$ T-cell epitope. In some cases, the heterologous polypeptide comprises 2 or more HCV-NS5A CD4$^+$ T-cell epitopes. In some cases, the heterologous polypeptide comprises one or more HCV CD8$^+$ T cell epitopes. In some cases, the heterologous polypeptide comprises a single HCV-NS5A CD8$^+$ T-cell epitope. In some cases, the heterologous polypeptide comprises 2 or more HCV-NS5A CD8$^+$ T-cell epitopes. In some cases, the heterologous polypeptide comprises at least one HCV CD4$^+$ T cell epitope and at least one HCV CD8$^+$ T cell epitope. In some cases, the heterologous polypeptide comprises at least one HCV-NS5A CD4$^+$ T cell epitope and at least one HCV-NS5A CD8$^+$ T cell epitope. In some cases, heterologous polypeptide comprises 2 or more HCV-NS5A CD4$^+$ T-cell epitopes and 2 or more HCV-NS5A CD8$^+$ T-cell epitopes. In some cases, the heterologous polypeptide comprises 2, 3, 4, or 5 HCV-NS5A CD4$^+$ T-cell epitopes and 2, 3, 4, or 5 HCV-NS5A CD8$^+$ T-cell epitopes.

In some cases, the heterologous polypeptide comprises a single T-cell epitope. In some cases, the heterologous polypeptide comprises a single HCV-NS5B T-cell epitope. In some cases, the heterologous polypeptide comprises 2 or more T-cell epitopes. In some cases, the heterologous polypeptide comprises 2 or more HCV-NS5B T-cell epitopes. In some cases, the heterologous polypeptide comprises 3 or more HCV-NS5B T-cell epitopes. In some cases, the heterologous polypeptide comprises 4 or more HCV-NS5B T-cell epitopes. In some cases, the heterologous polypeptide comprises a single HCV-NS5B $CD4^+$ T-cell epitope. In some cases, the heterologous polypeptide comprises 2 or more HCV-NS5B $CD4^+$ T-cell epitopes. In some cases, the heterologous polypeptide comprises one or more HCV $CD8^+$ T cell epitopes. In some cases, the heterologous polypeptide comprises a single HCV-NS5B $CD8^+$ T-cell epitope. In some cases, the heterologous polypeptide comprises 2 or more HCV-NS5B $CD8^+$ T-cell epitopes. In some cases, the heterologous polypeptide comprises at least one HCV $CD4^+$ T cell epitope and at least one HCV CD8+ T cell epitope. In some cases, the heterologous polypeptide comprises at least one HCV-NS5B CD4+ T cell epitope and at least one HCV-NS5B CD8+ T cell epitope. In some cases, heterologous polypeptide comprises 2 or more HCV-NS5B CD4+ T-cell epitopes and 2 or more HCV-NS5B CD8+ T-cell epitopes. In some cases, the heterologous polypeptide comprises 2, 3, 4, or 5 HCV-NS5B CD4+ T-cell epitopes and 2, 3, 4, or 5 HCV-NS5B CD8+ T-cell epitopes.

In some cases, the heterologous polypeptide comprises a single T-cell epitope. In some cases, the heterologous polypeptide comprises a single HCV-core T-cell epitope. In some cases, the heterologous polypeptide comprises 2 or more T-cell epitopes. In some cases, the heterologous polypeptide comprises 2 or more HCV-core T-cell epitopes. In some cases, the heterologous polypeptide comprises 3 or more HCV-core T-cell epitopes. In some cases, the heterologous polypeptide comprises 4 or more HCV-core T-cell epitopes. In some cases, the heterologous polypeptide comprises a single HCV-core CD4+ T-cell epitope. In some cases, the heterologous polypeptide comprises 2 or more HCV-core CD4+ T-cell epitopes. In some cases, the heterologous polypeptide comprises one or more HCV CD8+ T cell epitopes. In some cases, the heterologous polypeptide comprises a single HCV-core CD8+ T-cell epitope. In some cases, the heterologous polypeptide comprises 2 or more HCV-core CD8+ T-cell epitopes. In some cases, the heterologous polypeptide comprises at least one HCV CD4+ T cell epitope and at least one HCV CD8+ T cell epitope. In some cases, the heterologous polypeptide comprises at least one HCV-core CD4+ T cell epitope and at least one HCV-core CD8+ T cell epitope. In some cases, heterologous polypeptide comprises 2 or more HCV-core CD4+ T-cell epitopes and 2 or more HCV-core CD8+ T-cell epitopes. In some cases, the heterologous polypeptide comprises 2, 3, 4, or 5 HCV-core CD4+ T-cell epitopes and 2, 3, 4, or 5 HCV-core CD8+ T-cell epitopes.

In some cases, the heterologous polypeptide comprises a single T-cell epitope. In some cases, the heterologous polypeptide comprises a single HCV-p7 T-cell epitope. In some cases, the heterologous polypeptide comprises 2 or more T-cell epitopes. In some cases, the heterologous polypeptide comprises 2 or more HCV-p7 T-cell epitopes. In some cases, the heterologous polypeptide comprises 3 or more HCV-p7 T-cell epitopes. In some cases, the heterologous polypeptide comprises 4 or more HCV-p7 T-cell epitopes. In some cases, the heterologous polypeptide comprises a single HCV-p7 CD4+ T-cell epitope. In some cases, the heterologous polypeptide comprises 2 or more HCV-core CD4+ T-cell epitopes. In some cases, the heterologous polypeptide comprises one or more HCV CD8+ T cell epitopes. In some cases, the heterologous polypeptide comprises a single HCV-p7 CD8+ T-cell epitope. In some cases, the heterologous polypeptide comprises 2 or more HCV-p7 CD8+ T-cell epitopes. In some cases, the heterologous polypeptide comprises at least one HCV CD4+ T cell epitope and at least one HCV CD8+ T cell epitope. In some cases, the heterologous polypeptide comprises at least one HCV-p7 CD4+ T cell epitope and at least one HCV-p7 CD8+ T cell epitope. In some cases, heterologous polypeptide comprises 2 or more HCV-p7 CD4+ T-cell epitopes and 2 or more HCV-p7 CD8+ T-cell epitopes. In some cases, the heterologous polypeptide comprises 2, 3, 4, or 5 HCV-p7 CD4+ T-cell epitopes and 2, 3, 4, or 5 HCV-p7 CD8+ T-cell epitopes.

In some cases, the heterologous polypeptide comprises 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, or 63, of the T-cell epitopes set out in FIGS. 13A-13B. In some cases, the heterologous polypeptide comprises from 1 to 3, from 3 to 5, from 5 to 10, from 10 to 15, from 15 to 20, from 20 to 25, or from 25 to 30 of the T-cell epitopes set out in FIGS. 13A-13B. For example, in some cases, the heterologous polypeptide comprises the T-cell epitopes designated NS3-3, NS3-4, and NS3-11 in FIGS. 13A-13B and FIGS. 15A-15N. As another example, in some cases, the heterologous polypeptide comprises the T-cell epitopes designated NS2-1, NS2-2, NS2-3, NS2-7, and NS2-8 in FIGS. 13A-13B and FIGS. 15A-15N. As another example, in some cases, the heterologous polypeptide comprises the T-cell epitopes designated NS3-3, NS3-4, NS3-5, and NS3-11 in FIGS. 13A-13B and FIGS. 15A-15N. As another example, in some cases, the heterologous polypeptide comprises the T-cell epitopes designated NS3-3, NS3-4, NS3-5, NS3-6, NS3-7, NS3-11, NS3-12, and NS3-13 in FIGS. 13A-13B and FIGS. 15A-15N. As another example, in some cases, the heterologous polypeptide comprises the T-cell epitopes designated NS3-3, NS3-4, NS3-5, NS3-6, NS3-7, NS3-10, NS3-11, NS3-12, and NS3-13 in FIGS. 13A-13B and FIGS. 15A-15N. As another example, in some cases, the heterologous polypeptide comprises the T-cell epitopes designated Core-1, Core-2, Core-3, Core-4, Core-5, Core-6, Core-7, Core-8, Core-9, Core-10, Core-11, Core-12, Core-13, Core-14, Core-16, Core-17, Core-18, Core-19, Core-20, Core-21, and Core-22 in FIGS. 13A-13B and FIGS. 15A-15N. As another example, in some cases, the heterologous polypeptide comprises the T-cell epitopes designated NS3-1, NS3-2, NS3-3, NS3-4, NS3-5, NS3-6, NS3-7, NS3-9, NS3-10, NS3-11, NS3-12, and NS3-13 in FIGS. 13A-13B and FIGS. 15A-15N. As another example, in some cases, the heterologous polypeptide comprises the T-cell epitopes designated NS2-1, NS2-2, NS2-3, NS2-4, NS2-5, NS2-6, NS2-7, NS2-8, NS3-1, NS3-2, NS3-3, NS3-4, NS3-5, NS3-6, NS3-7, NS3-9, NS3-10, NS3-11, NS3-12, and NS3-13 in FIGS. 13A-13B and FIGS. 15A-15N. As another example, in some cases, the heterologous polypeptide comprises the T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, and NS4b-10 in FIGS. 13A-13B and FIGS. 15A-15N. As another example, in some cases, the heterologous polypeptide comprises the T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10, NS5a-1, NS5a-2, NS5b-1, and NS5b-2 in FIGS. 13A-13B and FIGS. 15A-15N. In some cases, the T-cell epitopes are contiguous. In some cases, any two T-cell epitopes are separated by linkers (e.g., a linker having a length of from 1 amino acid to about 50 amino acids, e.g., from 1 amino acid to 5 amino acids (aa), from 5 aa to 10 aa, from 10 aa to 15 aa, from 15 aa to 20 aa, from 20 aa to 25 aa, from 25 aa to 30 aa, from 30 aa to 40 aa, or from 40 aa to 50 aa).

In some cases, the heterologous polypeptide comprises at least one HCV CD4+ T cell epitope and at least one HCV CD8+ T cell epitope, where epitopes are conserved among HCV genotypes 1 and 2. In some cases, the heterologous polypeptide comprises at least one HCV CD4+ T cell epitope and at least one HCV CD8+ T cell epitope, where epitopes are conserved among HCV genotypes 1 and 3. In some cases, the heterologous polypeptide comprises at least one HCV CD4+ T cell epitope and at least one HCV CD8+ T cell epitope, where epitopes are conserved among HCV genotypes 1, 2, and 3. In some cases, the heterologous polypeptide comprises at least one HCV CD4+ T cell epitope and at least one HCV CD8+ T cell epitope, where epitopes are conserved among HCV genotypes 1, 2, 3, and 7. In some cases, the heterologous polypeptide comprises at least one HCV CD4+ T cell epitope and at least one HCV CD8+ T cell epitope, where epitopes are conserved among HCV genotypes 1-7.

The heterologous polypeptide can have a length of from about 10 amino acids to about 2000 amino acids; e.g., the heterologous polypeptide can have a length of from 10 amino acids (aa) to 15 aa, from 15 aa to 20 aa, from 20 aa to 25 aa, from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The heterologous polypeptide can have a length of from about 25 amino acids to about 2000 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 500 aa, from 500 aa to 600 aa, from 600 aa to 700 aa, from 700 aa to 800 aa, from 800 aa to 900 aa, from 900 aa to 1000 aa, from 1000 aa to 1100 aa, from 1100 aa to 1200 aa, from 1200 aa to 1300 aa, from 1300 aa to 1400 aa, from 1400 aa to 1500 aa, from 1500 aa to 1600 aa, from 1600 aa to 1700 aa, from 1700 aa to 1800 aa, from 1800 aa to 1900 aa, or from 1900 aa to 2000 aa. The heterologous polypeptide can have a length of from about 25 amino acids to about 3000 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 500 aa, from 500 aa to 600 aa, from 600 aa to 700 aa, from 700 aa to 800 aa, from 800 aa to 900 aa, from 900 aa to 1000 aa, from 1000 aa to 1100 aa, from 1100 aa to 1200 aa, from 1200 aa to 1300 aa, from 1300 aa to 1400 aa, from 1400 aa to 1500 aa, from 1500 aa to 1600 aa, from 1600 aa to 1700 aa, from 1700 aa to 1800 aa, from 1800 aa to 1900 aa, from 1900 aa to 2000 aa, from 2000 aa to 2250 aa, from 2250 aa to 2500 aa, from 2500 aa to 2750 aa, or from 2750 aa to 3000 aa.

The heterologous polypeptide can have a length of from about 25 amino acids to about 800 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The heterologous polypeptide can have a length of from about 25 amino acids to about 400 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, or from 350 aa to 400 aa. The heterologous polypeptide can have a length of 25 amino acids (aa), 26 aa, 27 aa, 28 aa, 29 aa, 30 aa, 31 aa, 32 aa, 33 aa, 34 aa, 35 aa, 36 aa, 37 aa, 38 aa, 39 aa, 40 aa, 41 aa, 42 aa, 43 aa, 44 aa, 45 aa, 46 aa, 47 aa, 48 aa, 49 aa, or 50 aa. The heterologous polypeptide can have a length of from about 100 amino acids (aa) to 800 aa, e.g., from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The heterologous polypeptide can have a length of from 25 aa to 30 aa. The heterologous polypeptide can have a length of from 30 aa to 40 aa. The heterologous polypeptide can have a length of from 40 aa to 50 aa. The heterologous polypeptide can have a length of from 50 aa to 60 aa (e.g., 50 aa, 51 aa, 52, aa, 53 aa, 54 aa, 55 aa, 56 aa, 57 aa, 58 aa, 59 aa, or 60 aa). The heterologous polypeptide can have a length of from 60 aa to 70 aa. The heterologous polypeptide can have a length of from 65 aa to 75 aa (e.g., 65, 66, 67, 68, 69, 70, 71, 72, 7, 74, or 75 aa). The heterologous polypeptide can have a length of 70 aa. The heterologous polypeptide can have a length of from 70 aa to 80 aa. The heterologous polypeptide can have a length of from 80 aa to 90 aa. The heterologous polypeptide can have a length of from 90 aa to 100 aa. The heterologous polypeptide can have a length of from 100 aa to 105 aa (e.g., 100, 101, 102, 103, 104, 105, 106, 107, 108, 109, or 110 aa). The heterologous polypeptide can have a length of 100 aa. The heterologous polypeptide can have a length of from 10 amino acids (aa) to 50 aa; e.g., from 10 aa to 15 aa, from 15 aa to 20 aa, from 20 aa to 25 aa, from 25 aa to 30 aa, from 30 aa to 35 aa, from 35 aa to 40 aa, from 40 aa to 45 aa, or from 45 aa to 50 aa. The heterologous polypeptide can have a length of from 10 amino acids (aa) to 20 aa, e.g., 10, 11, 12, 13, 14, 15, 16, 17, 18, 19, or 20 aa.

HCV NS3 T-cell Epitopes

In some cases, the heterologous polypeptide present in an E2 variant polypeptide of an E1/E2 heterodimer of the present disclosure includes one or more T-cell epitopes present in an HCV NS3 polypeptide. Examples of T-cell epitopes present in NS3 polypeptides are depicted in FIGS. 15A-15N, FIG. 13B, and FIGS. 14A-14B.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKL (SEQ ID NO: 1). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKL (SEQ ID NO: 1); and has a length of from 25 aa to 35 aa (e.g., 25 aa, 26 aa, 27 aa, 28 aa, 29 aa, 30 aa, 31 aa, 32 aa, 33 aa, 34 aa, or 35 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKL (SEQ ID NO: 1); and has a length of 29 amino acids. Such a polytope can include NS3

T-cell epitopes designated NS3-3, NS3-4, and NS3-11 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKLVALGI-NAVAYYRGLDVSVIPTSG (SEQ ID NO:2). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKLVALGI-NAVAYYRGLDVSVIPTSG (SEQ ID NO:2); and has a length of from 45 amino acids to 60 amino acids (e.g., 45 aa, 46 aa, 47 aa, 48 aa, 49 aa, 50 aa, 51 aa, 52 aa, 53 aa, 54 aa, 55 aa, 56 aa, 57 aa, 58 aa, 59 aa, or 60 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKLVALGI-NAVAYYRGLDVSVIPTSG (SEQ ID NO:2); and has a length of 52 amino acids. Such a polytope can include NS3 T-cell epitopes designated NS3-3, NS3-4, NS3-5, and NS3-11 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: KGGRHLIFCHSKKKCDELAAKLVALGINAVAYYR-GLDVSVIPTSGDVVVVATDALMTG FTGDFDSVIDCN (SEQ ID NO:3); and has a length of from 65 amino acids to 80 amino acids (e.g., 65 aa, 66 aa, 67 aa, 68 aa, 69 aa, 70 aa, 71 aa, 72 aa, 73 aa, 74 aa, 75 aa, 76 aa, 77 aa, 78 aa, 79 aa, or 80 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: KGGRHLIFCHSKKKCDE-LAAKLVALGINAVAYYRGLDVSVIPTSGDVVVVAT-DALMTG FTGDFDSVIDCN (SEQ ID NO:3); and has a length of 70 amino acids. Such a polytope can include NS3 T-cell epitopes designated NS3-3, NS3-4, NS3-5, NS3-6, NS3-7, NS3-11, NS3-12, and NS3-13 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: VALSTTGEIPFYGKAIPLEVIKGGRHLIFCHSKK-KCDELAAKLVALGINAVAYYRGLDVS VIPTSGDV-VVVATDALMTGFTGDFDSVIDCNTCVTQTVDF (SEQ ID NO:4); and has a length of from 95 amino acids (aa) to 105 aa (e.g., 95 aa, 96 aa, 97 aa, 98 aa, 99 aa, 100 aa, 101 aa, 102 aa, 103 aa, 104 aa, or 105 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: VALSTT-GEIPFYGKAIPLEVIKGGRHLIFCHSKKKCDELAAK-LVALGINAVAYYRGLDVS VIPTSGDVVVVATDALMT-GFTGDFDSVIDCNTCVTQTVDF (SEQ ID NO:4); and has a length of 100 amino acids. Such a polytope can include NS3 T-cell epitopes designated NS3-3, NS3-4, NS3-5, NS3-6, NS3-7, NS3-10, NS3-11, NS3-12, and NS3-13 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQIVG-GVYLLPRRGPRLGVRATRKTSERSQP RGRRQPIP-KARRPEGRTWAQPGYPWPLYGNEGCGWAGWLL-SPRGSRPSWGPTDPRRRS RNLGKVIDTLTCGFADLMGYIPLVGAPLGGAARAL-AHGVRVLEDGVNYATGNLPGCSF SIFLLALLSCLTV-PASA (SEQ ID NO:9); and has a length of from 190 amino acids (aa) to 200 aa (e.g., 190 aa, 191 aa, 192 aa, 193 aa, 194 aa, 195 aa, 196 aa, 197 aa, 198 aa, 199 aa, or 200 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQIVG-GVYLLPRRGPRLGVRATRKTSERSQP RGRRQPIP-KARRPEGRTWAQPGYPWPLYGNEGCGWAGWLL-SPRGSRPSWGPTDPRRRS RNLGKVIDTLTCGFADLMGYIPLVGAPLGGAARAL-AHGVRVLEDGVNYATGNLPGCSF SIFLLALLSCLTV-PASA (SEQ ID NO:9); and has a length of 191 amino acids.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGKSTKVPAAYAAQGYKVLVLNPSVAATLG-FGAYMSKAHGIDPNIRTGVRTIT TGSPITYSTYGK-FLADGGCSGGAYDIIICDECHSTDATSILGIGTV-LDQAETAGARLVVLA TATPPGSVTVPHPNIEEVALSTTGEIPFYGKAIPLEVIK-GGRHLIFCHSKKKCDELAAKLVALGINAVAYYRGLD-VSVIPTSGDVVVVATDALMTGFTGDFDSVIDCN (SEQ ID NO: 10); and has a length of from 215 amino acids (aa) to 235 aa (e.g., 215 aa, 216 aa, 217 11, 218 aa, 219 aa, 220 aa, 221 aa, 222 aa, 223 aa, 224 aa, 225 aa, 226 aa, 227 aa, 228 aa, 229 aa, 230 aa, 231 aa, 232 aa, 233 aa, 234 aa, or 235 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence:

(SEQ ID NO: 10)
LHAPTGSGKSTKVPAAYAAQGYKVLVLNPSVAATLGFGAYMSKAHGIDPNI

RTGVRTITTGSPITYSTYGKFLADGGCSGGAYDIIICDECHSTDATSILGI

GTVLDQAETAGARLVVLATATPPGSVTVPHPNIEEVALSTTGEIPFYGKAI

PLEVIKGGRHLIFCHSKKKCDELAAKLVALGINAVAYYRGLDVSVIPTSGD

VVVVATDALMTGFTGDFDSVIDCN;

and has a length of 228 amino acids. Such a polytope can include NS3 T-cell epitopes designated NS3-1, NS3-2, NS3-3, NS3-4, NS3-5, NS3-6, NS3-7, NS3-9, NS3-10, NS3-11, NS3-12, and NS3-13 in FIG. 13B and FIGS. 15A-15N.

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1265-1279 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1309-1323 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1401-1415 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1402-1412 of the amino acid sequence designated "Consensus" in FIGS. 16A-16L, or a corresponding HCV NS3 amino acid sequence of any HCV genotype; and the HCV NS3 T-cell epitope can have a length of from 11 amino acids (aa) to 16 amino acids (e.g., 11 aa, 12 aa, 13 aa, 14 aa, 15 aa, or 16 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1429-1439 of the amino acid sequence designated "Consensus" in FIGS. 16A-16L, or a corresponding HCV NS3 amino acid sequence of any HCV genotype; and the HCV NS3 T-cell epitope can have a length of from 11 amino acids (aa) to 16 amino acids (e.g., 11 aa, 12 aa, 13 aa, 14 aa, 15 aa, or 16 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1450-1464 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1453-1467 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1577-1591 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1306-1314 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1387-1394 of the amino acid sequence designated "Consensus" in FIGS. 16A-16L, or a corresponding HCV NS3 amino acid sequence of any HCV genotype; and the HCV NS3 T-cell epitope can have a length of from 1 amino acids (aa) to 15 amino acids (e.g., 8 aa, 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1405-1413 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1450-1458 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1457-1465 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1610-1618 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

HCV NS2 T-cell Epitopes

In some cases, the heterologous polypeptide present in an E2 variant polypeptide of an E1/E2 heterodimer of the present disclosure includes one or more T-cell epitopes present in an HCV NS2 polypeptide. Examples of T-cell epitopes present in NS2 polypeptides are depicted in FIGS. 15A-15N, and FIG. 13A.

For example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 955-974 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 975-994 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 985-1004 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1015-1034 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1035-1054 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 924-933 of the amino acid sequence designated "Consensus" in FIGS. 16A-16L, or a corresponding HCV NS2 amino acid sequence of any HCV genotype; and the NS2 T cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 961-970 of the amino acid sequence designated "Consensus" in FIGS. 16A-16L, or a corresponding HCV NS2 amino acid sequence of any HCV genotype; and the NS2 T cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 989-997 of the amino acid sequence designated "Consensus" in FIGS. 16A-16L, or a corresponding HCV NS2 amino acid sequence of any HCV genotype; and the NS2 T cell epitope can have a length of from 9 amino acids (aa) to 15 amino acids (e.g., 9 aa, 10 aa, 11 aa, 12 aa, 13 aa, 14 aa, or 15 aa).

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 50 aa (e.g., from 10 aa to 25 aa, or from 25 aa to 50 aa) of amino acids 955-1004 of the amino acid sequence designated "Consensus" in FIGS. 16A-16L, or a corresponding HCV NS2 amino acid sequence of any HCV genotype; and has a length of from 10 amino acids (aa) to 25 aa, or from 25 aa to 50 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 955-1004 of the amino acid sequence designated "Consensus" in FIGS. 16A-16L, or a corresponding HCV NS2 amino acid sequence of any HCV genotype; and has a length of about 50 amino acids.

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 553 aa (e.g., from 10 aa to 25 aa, from 25 aa to 50 aa, from 50 aa to 100 aa, from 100 aa to 200 aa, from 200 aa to 300 aa, from 300 aa to 400 aa, from 400 aa to 500 aa, or from 500 aa to 553 aa) of amino acids 917-1469 of the amino acid sequence designated "Consensus" in FIGS. 16A-16L, or a corresponding HCV NS2 and NS3 amino acid sequence of any HCV genotype; and has a length of from 10 amino acids (aa) to 25 aa, from 25 aa to 50 aa, from 50 aa to 100 aa, from 100 aa to 200 aa, from 200 aa to 300 aa, from 300 aa to 400 aa, from 400 aa to 500 aa, or from 500 aa to 553 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 917-1469 of the amino acid sequence designated "Consensus" in FIGS. 16A-16L, or a corresponding HCV NS2 and NS3 amino acid sequence of any HCV genotype; and has a length of about 553 amino acids.

The heterologous polypeptide can comprise an amino acid sequence having at least about 20%, at least about 25%, at least about 30%, at least about 35%, at least about 40%, at least about 45%, at least about 50%, at least about 60%, at least about 0%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRDWAHNGLRDLAVAVEPVVFSQMETKLITWGADT (SEQ ID NO: 11). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRDWAHNGLRDLAVAVEPVVFSQMETKLITWGADT (SEQ ID NO:11); and has a length of from 50 amino acids to 60 amino acids (e.g., 50 aa, 51 aa, 52 aa, 53 aa, 54 aa, 55 aa, 56 aa, 57 aa, 58 aa, 59 aa, or 60 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRDWAHNGLRDLAVAVEPVVFSQMETKLITWGADT (SEQ ID NO: 11); and has a length of 50 amino acids. Such a polytope can include NS2 T-cell epitopes designated NS2-1, NS2-2, NS2-3, NS2-7, and NS2-8 in FIG. 13A and FIGS. 15A-15N.

HCV NS4A T-Cell Epitopes

In some cases, the heterologous polypeptide present in an E2 variant polypeptide of an E1/E2 heterodimer of the present disclosure includes one or more T-cell epitopes present in an HCV NS4A polypeptide. Examples of T-cell epitopes present in NS4A polypeptides are depicted in FIGS. 15A-15N and FIG. 13B.

The heterologous polypeptide can comprise an NS4A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1683-1692 of the amino acid sequence designated "Consensus" in FIGS. 16A-16L, or a corresponding HCV NS4A amino acid sequence of any HCV genotype; and the NS4A T-cell epitope can have a length of from 10 amino acids (aa) to 15 amino acids (e.g., 10 aa, 11 aa, 12 aa, 13 aa, 14 aa, or 15 aa).

HCV NS4B T-Cell Epitopes

In some cases, the heterologous polypeptide present in an E2 variant polypeptide of an E1/E2 heterodimer of the present disclosure includes one or more T-cell epitopes present in an HCV NS4B polypeptide. Examples of T-cell epitopes present in NS4B polypeptides are depicted in FIGS. 15A-15N and FIG. 13B.

As one example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1790-1801 of the amino acid sequence designated "Consensus" in FIGS. 16A-16L, or a corresponding HCV NS4B amino acid sequence of any HCV genotype; and the NS4B T-cell epitope can have a length of from 12 amino acids (aa) to 20 amino acids (e.g., 12 aa, 13 aa, 14 aa, 15 aa, 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1792-1802 of the amino acid sequence designated "Consensus" in FIGS. 16A-16L, or a corresponding HCV NS4B amino acid sequence of any HCV genotype; and the NS4B T-cell epitope can have a length of from 11 amino acids (aa) to 20 amino acids (e.g., 11 aa, 12 aa, 13 aa, 14 aa, 15 aa, 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1898-1905 of the amino acid sequence designated "Consensus" in FIGS. 16A-16L, or a corresponding HCV NS4B amino acid sequence of any HCV genotype; and the NS4B T-cell epitope can have a length of from 8 amino acids (aa) to 15 amino acids (e.g., 8 aa, 9 aa, 10 aa, 11 aa, 12 aa, 13 aa, 14 aa, or 15 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1921-1935 of the amino acid sequence designated "Consensus" in FIGS. 16A-16L, or a corresponding HCV NS4B amino acid sequence of any HCV genotype; and the NS4B T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1922-1941 of the amino acid sequence designated "Consensus" in FIGS. 16A-16L, or a corresponding HCV NS4B amino acid sequence of any HCV genotype; and the NS4B T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1928-1947 of the amino acid sequence designated "Consensus" in FIGS. 16A-16L, or a corresponding HCV NS4B amino acid sequence of any HCV genotype; and the NS4B T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1868-1876 of the amino acid sequence designated "Consensus" in FIGS. 16A-16L, or a corresponding HCV NS4B amino acid sequence of any HCV genotype; and the NS4B T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1927-1942 of the amino acid sequence designated "Consensus" in FIGS. 16A-16L, or a corresponding HCV NS4B amino acid sequence of any HCV genotype; and the NS4B T-cell epitope can have a length of from 16 amino acids (aa) to 20 amino acids (e.g., 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1932-1940 of the amino acid sequence designated "Consensus" in FIGS. 16A-16L, or a corresponding HCV NS4B amino acid sequence of any HCV genotype; and the NS4B T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1948-1962 of the amino acid sequence designated "Consensus" in FIGS. 16A-16L, or a corresponding HCV NS4B amino acid sequence of any HCV genotype; and the NS4B T-cell epitope can have a length of from 15 amino acids (aa) to 20 amino acids (e.g., 15 aa, 16 aa, 17 aa, 18 aa, 19 aa, or 20 aa).

HCV NS5A T-Cell Epitopes

In some cases, the heterologous polypeptide present in an E2 variant polypeptide of an E1/E2 heterodimer of the present disclosure includes one or more T-cell epitopes present in an HCV NS5A polypeptide. Examples of T-cell epitopes present in NS5A polypeptides are depicted in FIGS. 15A-15N and FIG. 13B.

As one example, the heterologous polypeptide can comprise an NS5A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2218-2232 of the amino acid sequence designated "Consensus" in FIGS. 16A-16L, or a corresponding HCV NS5A amino acid sequence of any HCV genotype; and the NS5A T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an NS5A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2309-2317 of the amino acid sequence designated "Consensus" in FIGS. 16A-16L, or a corresponding HCV NS5A amino acid sequence of any HCV genotype; and the NS5A T-cell epitope can have a length of from 9 amino acids (aa) to 15 amino acids (e.g., 9 aa, 10 aa, 11 aa, 12 aa, 13 aa, 14 aa, or 15 aa).

HCV NS5B T-Cell Epitopes

In some cases, the heterologous polypeptide present in an E2 variant polypeptide of an E1/E2 heterodimer of the present disclosure includes one or more T-cell epitopes present in an HCV NS5B polypeptide. Examples of T-cell epitopes present in NS5B polypeptides are depicted in FIGS. 15A-15N and FIG. 13B.

As one example, the heterologous polypeptide can comprise an NS5B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2847-2851 of the amino acid sequence designated "Consensus" in FIGS. 16A-16L, or a corresponding HCV NS5B amino acid sequence of any HCV genotype; and the NS5B T-cell epitope can have a length of from 5 amino acids (aa) to 10 amino acids (e.g., 5 aa, 6 aa, 7 aa, 8 aa, 9 aa, or 10 aa).

As another example, the heterologous polypeptide can comprise an NS5B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2602-2610 of the amino acid sequence designated "Consensus" in FIGS. 16A-16L, or a corresponding HCV NS5B amino acid sequence of any HCV genotype; and the NS5B T-cell epitope can have a length of from 9 amino acids (aa) to 15 amino acids (e.g., 9 aa, 10 aa, 11 aa, 12 aa, 13 aa, 14 aa, or 15 aa).

HCV Core T-Cell Epitopes

In some cases, the heterologous polypeptide present in an E2 variant polypeptide of an E1/E2 heterodimer of the present disclosure includes one or more T-cell epitopes present in an HCV core polypeptide. Examples of T-cell epitopes present in HCV Core polypeptides are depicted in FIGS. 15A-15N and FIG. 13A.

As one example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1-20 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 11-30 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 21-40 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 39-63 of the amino acid sequence designated "Consensus" in FIGS. 16A-16L, or a corresponding HCV core amino acid sequence of any HCV genotype; and the HCV core T-cell epitope can have a length of from 23 amino acids (aa) to 28 amino acids (e.g., 23 aa, 24 aa, 25 aa, 26 aa, 27 aa, or 28 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 47-70 of the amino acid sequence designated "Consensus" in FIGS. 16A-16L, or a corresponding HCV core amino acid sequence of any HCV genotype; and the HCV core T-cell epitope can have a length of from 24 amino acids (aa) to 29 amino acids (e.g., 24 aa, 25 aa, 26 aa, 27 aa, 28 aa, or 29 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 61-80 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 71-90 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 81-100 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 91-110 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 101-115 of the amino acid sequence designated "Consensus" in FIGS. 16A-16L, or a corresponding HCV core amino acid sequence of any HCV genotype; and the HCV core T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 111-130 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 125-139 of the amino acid sequence designated "Consensus" in FIGS. 16A-16L, or a corresponding HCV core amino acid sequence of any HCV genotype; and the HCV core T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 131-150 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 151-170 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 161-180 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 35-44 of the amino acid sequence designated "Consensus" in FIGS. 16A-16L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 43-51 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 51-59 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 129-137 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 131-140 of the amino acid sequence designated "Consensus" in FIGS. 16A-16L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 150-158 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 154-162 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 168-176 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 177-187 of the amino acid sequence designated "Consensus" in FIGS. 16A-16L, or a corresponding HCV core amino acid sequence of any HCV genotype; and the HCV core T-cell epitope can have a length of from 11 amino acids (aa) to 16 amino acids (e.g., 11 aa, 12 aa, 13 aa, 14 aa, 15 aa, or 16 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 178-187 of the amino acid sequence designated "Consensus" in FIGS. 16A-16L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 191 aa (e.g., from 10 aa to 25 aa, from 25 aa to 50 aa, from 50 aa to 75 aa, from 75 aa to 100 aa, from 100 aa to 150 aa, or from 150 aa to 191 aa) of amino acids 1-191 of the amino acid sequence designated "Consensus" in FIGS. 16A-16L, or a corresponding HCV core amino acid sequence of any HCV genotype; and has a length of from 10 amino acids (aa) to 25 aa, from 25 aa to 50 aa, from 50 aa to 100 aa, or from 100 aa to 150 aa, or from 150 aa to 191 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1-191 of the amino acid sequence designated "Consensus" in FIGS. 16A-16L, or a corresponding HCV core amino acid sequence of any HCV genotype; and has a length of about 191 amino acids.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQIVG-GVYLLPRRGPRLGVRATRKTS ERSQPRGRRQPIP-KARRPEGRTWAQPGYPWPLYGNEGCGWAGWLL-SPRGSRPS WGPTDPRRRSRNLGKVIDTLTCGFADLMGYIPLVGA-PLGGAARALAHGVRVLE DGVNYATGNLPG (SEQ ID NO:63); and has a length of from 171 amino acids (aa) to 180 aa (e.g., 171 aa, 172 aa, 173 aa, 174 aa, 175 aa, 176 aa, 177 aa, 178 aa, 179 aa, or 180 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPK-PQRKTKRNTNRRPQDVKFPGGGQIVGGVYLLPRRG-PRLGVRATRKTS ERSQPRGRRQPIPKARRPEGRT-WAQPGYPWPLYGNEGCGWAGWLLSPRGSRPS WGPTDPRRRSRNLGKVIDTLTCGFADLMGYIPLVGA-PLGGAARALAHGVRVLE DGVNYATGNLPG (SEQ ID NO:63); and has a length of 171 amino acids. Such a polytope can include core T-cell epitopes designated Core-1, Core-2, Core-3, Core-4, Core-5, Core-6, Core-7, Core-8, Core-9, Core-10, Core-11, Core-12, Core-13, Core-14, Core-16, Core-17, Core-18, Core-19, Core-20, Core-21, Core-22 in FIG. 13A and FIGS. 15A-15N.

HCV p7 T-Cell Epitopes

In some cases, the heterologous polypeptide present in an E1/E2 variant polypeptide of an E1/E2 heterodimer of the present disclosure includes one or more T-cell epitopes present in an HCV p7 polypeptide. Examples of T-cell epitopes present in HCV p7 polypeptides are depicted in FIGS. 15A-15N or FIG. 13A.

As another example, the heterologous polypeptide can comprise an HCV p7 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 803-811 of the amino acid sequence designated "Consensus" in FIGS. 16A-16L, or a corresponding HCV p7 amino acid sequence of any HCV genotype; and the HCV p7 T-cell epitope can have a length of from 9 amino acids (aa) to 15 amino acids (e.g., 9 aa, 10 aa, 11 aa, 12 aa, 13 aa, 14 aa, or 15 aa).

Polytopes Including HCV T-Cell Epitopes from more than One HCV Polypeptide other than E1 and E2

As noted above, a heterologous polypeptide can include T-cell epitopes from more than one HCV polypeptide other than E1 and E2.

As one example, a heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: QASLLKVPYFVRVQGLLRICALARKMAG-GHYVQMAIIKLGALTGTYVYNALTP LRDWAHNGL-RDLAVAVEPVVFSQMETKLITWGADTAACGDI-INGLPVSARRGR EILLGPADGMVSKGWRLLAPITAYAQQTRGLLGCIIT-SLTGRDKNQVEGEVQIVS TAAQTFLATCINGVCWT-VYHGAGTRTIASPKGPVIQMYTNVDQDLVGW-PAPQG ARSLTPCTCGSSDLYLVTRHADVIPVRRRGDSRGSLL-SPRPISYLKGSAGGPLLCP AGHAVGIFRAAVCTRG-VAKAVDFIPVENLETTMRSPVFTDNSSPPAVPQSFQVA HLHAPTGSGKSTKVPAAYAAQGYKVLVLNPSVAATL-GFGAYMSKAHGIDPNIR TGVRTITTGSPITYSTYGK-FLADGGCSGGAYDIIICDECHSTDATSILGIGTVLDQA ETAGARLVVLATATPPGSVTVPHPNIEEVALSTTGEIP-FYGKAIPLEVIKGGRHLIF CHSKKKCDELAAKLVAL-GINAVAYYRGLDVSVIPTSGDVVVVATDALMTGFTG DFDSVIDCN (SEQ ID NO:12); and has a length of from 550 amino acids (aa) to 560 aa (e.g., 550 aa, 551 aa, 552 aa, 553 aa, 554 aa, 555 aa, 556 aa, 557 aa, 558 aa, 559 aa, or 560 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: QASLLKVPYFVRVQGLLRICALARKMAG-GHYVQMAIIKLGALTGTYVYNALTP LRDWAHNGL-RDLAVAVEPVVFSQMETKLITWGADTAACGDI-INGLPVSARRGR EILLGPADGMVSKGWRLLAPITAYAQQTRGLLGCIIT-SLTGRDKNQVEGEVQIVS TAAQTFLATCINGVCWT-VYHGAGTRTIASPKGPVIQMYTNVDQDLVGW-PAPQG ARSLTPCTCGSSDLYLVTRHADVIPVRRRGDSRGSLL-SPRPISYLKGSAGGPLLCP AGHAVGIFRAAVCTRG-VAKAVDFIPVENLETTMRSPVFTDNSSPPAVPQSFQVA HLHAPTGSGKSTKVPAAYAAQGYKVLVLNPSVAATL-GFGAYMSKAHGIDPNIR TGVRTITTGSPITYSTYGK-FLADGGCSGGAYDIIICDECHSTDATSILGIGTVLDQA ETAGARLVVLATATPPGSVTVPHPNIEEVALSTTGEIP-FYGKAIPLEVIKGGRHLIF CHSKKKCDELAAKLVAL-GINAVAYYRGLDVSVIPTSGDVVVVATDALMTGFTG DFDSVIDCN (SEQ ID NO: 12); and has a length of 553 amino acids. Such a polytope can include T-cell epitopes designated NS2-1, NS2-2, NS2-3, NS2-4, NS2-5, NS2-6, NS2-7, NS2-8, NS3-1, NS3-2, NS3-3, NS3-4, NS3-5, NS3-6, NS3-7, NS3-9, NS3-10, NS3-11, NS3-12, and NS3-13 in FIGS. 13A-13B and FIGS. 15A-15N. This polytope is also referred to as "TP553" (FIGS. 14A-14D). In order to prevent self cleavage of the TP553 polytope (amino acids 917-1469) (FIGS. 15E-G) at the NS2-NS3 junction that is mediated by the catalytic domain of the NS2 protease (amino acids 917-1040), the histidine at position 966 (H966), a critical residue for NS2 protease activity, is mutated to alanine (H966A) (FIG. 15E).

As another example, the heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 778 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 450 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 778 aa) the following amino acid sequence: LHAPTGSGKSTKVPAAYAAQGYKVLVLNPSVAATLGFGAYMSKAHGIDPNIRTGVRTIT TGSPITYSTYGKFLADGGCSGGAYDIIICDECHSTDATSILGIGTVLDQAETAGARLVVLA TATPPGSVTVPHPNIEEVALSTTGEIPFYGKAIPLEVIKGGRHLIFCHSKKKCDELAAKLV ALGINAVAYYRGLDVSVIPTSGDVVVVATDALMTGFTGDFDSVIDCNTCVTQTVDFSLD PTFTIETTTLPQDAVSRTQRRGRTGRGKPGIYRFVAPGERPSGMFDSSVLCECYDAGCA WYELTPAETTVRLRAYMNTPGLPVCQDHLEFWEGVFTGLTHIDAHFLSQTKQSGENLP YLVAYQATVCARAQAPPPSWDQMWKCLIRLKPTLHGPTPLLYRLGAVQNEVTLTHPIT KYIMTCMSADLEVVTSTWVLVGGVLAALAAYCLSTGCVVIVGRIVLSGKPAIIPDREVL YREFDEMEECSQHLPYIEQGMMLAEQFKQKALGLLQTASRQAEVIAPAVQTNWQKLEA FWAKHMWNFISGIQYLAGLSTLPGNPAIASLMAFTAAVTSPLTTSQTLLFNILGGWVAA QLAAPGAATAFVGAGLAGAAIGSVGLGKVLVDILAGYGAGVAGALVAFKIMSGEVPST EDLVNLLPAILSPGALVVGVVCAAILRRHVGPGEGAVQWMNRLIAFASRGNHVSPTHY VPESDAAARVTAILSSLTVTQLLRRLHQWISSECTTPCSGSWLRDIWDWICEVLSDFKTW LKAKLMPQLPG (SEQ ID NO:64). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 778 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 450 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 778 aa) of the following amino acid sequence: LHAPTGSGKSTKVPAAYAAQGYKVLVLNPSVAATLGFGAYMSKAHGIDPNIRTGVRTIT TGSPITYSTYGKFLADGGCSGGAYDIIICDECHSTDATSILGIGTVLDQAETAGARLVVLA TATPPGSVTVPHPNIEEVALSTTGEIPFYGKAIPLEVIKGGRHLIFCHSKKKCDELAAKLV ALGINAVAYYRGLDVSVIPTSGDVVVVATDALMTGFTGDFDSVIDCNTCVTQTVDFSLD PTFTIETTTLPQDAVSRTQRRGRTGRGKPGIYRFVAPGERPSGMFDSSVLCECYDAGCA WYELTPAETTVRLRAYMNTPGLPVCQDHLEFWEGVFTGLTHIDAHFLSQTKQSGENLP YLVAYQATVCARAQAPPPSWDQMWKCLIRLKPTLHGPTPLLYRLGAVQNEVTLTHPIT KYIMTCMSADLEVVTSTWVLVGGVLAALAAYCLSTGCVVIVGRIVLSGKPAIIPDREVL YREFDEMEECSQHLPYIEQGMMLAEQFKQKALGLLQTASRQAEVIAPAVQTNWQKLEA FWAKHMWNFISGIQYLAGLSTLPGNPAIASLMAFTAAVTSPLTTSQTLLFNILGGWVAA QLAAPGAATAFVGAGLAGAAIGSVGLGKVLVDILAGYGAGVAGALVAFKIMSGEVPST EDLVNLLPAILSPGALVVGVVCAAILRRHVGPGEGAVQWMNRLIAFASRGNHVSPTHY VPESDAAARVTAILSSLTVTQLLRRLHQWISSECTTPCSGSWLRDIWDWICEVLSDFKTW LKAKLMPQLPG (SEQ ID NO:64); and has a length of from 25 amino acids (aa) to 50 aa, from 50 aa to 100 aa, from 100 aa to 200 aa, from 200 aa to 300 aa, from 300 aa to 400 aa, from 400 aa to 500 aa, from 500 aa to 600 aa, from 600 aa to 700 aa, or from 700 aa to 778 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGKSTKVPAAYAAQGYKVLVLNPSVAATLGFGAYMSKAHGIDPNIRTGVRTIT TGSPITYSTYGKFLADGGCSGGAYDIIICDECHSTDATSILGIGTVLDQAETAGARLVVLA TATPPGSVTVPHPNIEEVALSTTGEIPFYGKAIPLEVIKGGRHLIFCHSKKKCDELAAKLV ALGINAVAYYRGLDVSVIPTSGDVVVVATDALMTGFTGDFDSVIDCNTCVTQTVDFSLD PTFTIETTTLPQDAVSRTQRRGRTGRGKPGIYRFVAPGERPSGMFDSSVLCECYDAGCA WYELTPAETTVRLRAYMNTPGLPVCQDHLEFWEGVFTGLTHIDAHFLSQTKQSGENLP YLVAYQATVCARAQAPPPSWDQMWKCLIRLKPTLHGPTPLLYRLGAVQNEVTLTHPIT KYIMTCMSADLEVVTSTWVLVGGVLAALAAYCLSTGCVVIVGRIVLSGKPAIIPDREVL YREFDEMEECSQHLPYIEQGMMLAEQFKQKALGLLQTASRQAEVIAPAVQTNWQKLEA FWAKHMWNFISGIQYLAGLSTLPGNPAIASLMAFTAAVTSPLTTSQTLLFNILGGWVAA QLAAPGAATAFVGAGLAGAAIGSVGLGKVLVDILAGYGAGVAGALVAFKIMSGEVPST EDLVNLLPAILSPGALVVGVVCAAILRRHVGPGEGAVQWMNRLIAFASRGNHVSPTHY VPESDAAARVTAILSSLTVTQLLRRLHQWISSECTTPCSGSWLRDIWDWICEVLSDFKTW LKAKLMPQLPG (SEQ ID NO:64); and has a length of 778 amino acids. Such a polytope can include T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS2-14, NS4a-1, NS4b-1, NS4b-2, NS4b-3, NS4b-4, NS4b-5, NS4b-6, NS4b-7, NS4b-8, NS4b-9, and NS4b-10 in FIG. 13B and FIGS. 15A-15N.

As another example, the heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 1985 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 500 aa, from 500 aa to 750 aa, from 750 aa to 1000 aa, from 1000 aa to 1500 aa, or from 1500 aa to 1985 aa) of the following amino acid sequence:

(SEQ ID NO: 13)
APITAYAQQTRGLLGCIITSLTGRDKNQVEGEVQIVSTAAQTFLATCING

VCWTVYHGAGTRTIASPKGPVIQMYTNVDQDLVGWPAPQGARSLTPCTCG

SSDLYLVTRHADVIPVRRRGDSRGSLLSPRPISYLKGSAGGPLLCPAGHA

VGIFRAAVCTRGVAKAVDFIPVENLETTMRSPVFTDNSSPPAVPQSFQVA

HLHAPTGSGKSTKVPAAYAAQGYKVLVLNPSVAATLGFGAYMSKAHGIDP

NIRTGVRTITTGSPITYSTYGKFLADGGCSGGAYDIIICDECHSTDATSI

LGIGTVLDQAETAGARLVVLATATPPGSVTVPHPNIEEVALSTTGEIPFY

GKAIPLEVIKGGRHLIFCHSKKKCDELAAKLVALGINAVAYYRGLDVSVI

PTSGDVVVVATDALMTGFTGDFDSVIDCNTCVTQTVDFSLDPTFTIETTT

LPQDAVSRTQRRGRTGRGKPGIYRFVAPGERPSGMFDSSVLCECYDAGCA

WYELTPAETTVRLRAYMNTPGLPVCQDHLEFWEGVFTGLTHIDAHFLSQT

KQSGENLPYLVAYQATVCARAQAPPPSWDQMWKCLIRLKPTLHGPTPLLY

RLGAVQNEVTLTHPITKYIMTCMSADLEVVTSTWVLVGGVLAALAAYCLS

TGCVVIVGRIVLSGKPAIIPDREVLYREFDEMEECSQHLPYIEQGMMLAE

QFKQKALGLLQTASRQAEVIAPAVQTNWQKLEAFWAKHMWNFISGIQYLA

GLSTLPGNPAIASLMAFTAAVTSPLTTSQTLLFNILGGWVAAQLAAPGAA

TAFVGAGLAGAAIGSVGLGKVLVDILAGYGAGVAGALVAFKIMSGEVPST

EDLVNLLPAILSPGALVVGVVCAAILRRHVGPGEGAVQWMNRLIAFASRG

NHVSPTHYVPESDAAARVTAILSSLTVTQLLRRLHQWISSECTTPCSGSW

LRDIWDWICEVLSDFKTWLKAKLMPQLPGIPFVSCQRGYRGVWRGDGIMH

TRCHCGAEITGHVKNGTMRIVGPRTCRNMWSGTFPINAYTTGPCTPLPAP

NYTFALWRVSAEEYVEIRQVGDFHYVTGMTTDNLKCPCQVPSPEFFTELD

GVRLHRFAPPCKPLLREEVSFRVGLHEYPVGSQLPCEPEPDVAVLTSMLT

DPSHITAEAAGRRLARGSPPSVASSSASQLSAPSLKATCTANHDSPDAEL

IEANLLWRQEMGGNITRVESENKVVILDSFDPLVAEEDEREISVPAEILR

KSRRFAPALPIWARPDYNPPLLETWKKPDYEPPVVHGCPLPPPQSPPVPP

PRKKRTVVLTESTVSTALAELATKSFGSSSTSGITGDNTTTSSEPAPSGC

PPDSDAESYSSMPPLEGEPGDPDLSDGSWSTVSSEADTEDVVCCSMSYSW

TGALVTPCAAEEQKLPINALSNSLLRHHNLVYSTTSRSACQRQKKVTFDR

LQVLDSHYQDVLKEVKAAASKVKANLLSVEEACSLTPPHSAKSKFGYGAK

DVRCHARKAVNHINSVWKDLLEDSVTPIDTTIMAKNEVFCVQPEKGGRKP

ARLIVFPDLGVRVCEKMALYDVVSKLPLAVMGSSYGFQYSPGQRVEFLVQ

AWKSKKTPMGFSYDTRCFDSTVTESDIRTEEAIYQCCDLDPQARVAIKSL

TERLYVGGPLTNSRGENCGYRRCRASGVLTTSCGNTLTCYIKARAACRAA

GLQDCTMLVCGNNLVVICESAGVQEDAASLRAFTEAMTRYSAPPGDPPQP

EYDLELITSCSSNVSVAHDGAGKRVYYLTRDPTTPLARAAWETARHTPVN

SWLGNIIMFAPTLWARMILMTHFFSVLIARDQLEQALDCEIYGACYSIEP

LDLPPIIQRLHGLSAFSLHSYSPGEINRVAACLRKLGVPPLRAWRHRARS

VRARLLSRGGGRAAICGKYLFNWAVRTKLKLTPIAAAGQLDLSGWFTAGYS

GGDIYHSVSHARPRWFWFCLLLLAAGVGIYLLPNR.

In some cases, the heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: APITAYAQQTRGLLGCIITSLTGRDKNQVEG-EVQIVSTAAQTFLATCINGVCWTV YHGAGTRTIASP-KGPVIQMYTNVDQDLVGWPAPQGARSLTPCTCGSS-DLYLVT RHADVIPVRRRGDSRGSLLSPRPISYLKGS AGGPLLCPAGHAVGIFRAAVCTRGV AKAVDFIPVEN-LETTMRSPVFTDNSSPPAVPQSFQVAHLHAPTGSGK-STKVPAA YAAQGYKVLVLNPSVAATLGFGAYM-SKAHGIDPNIRTGVRTITTGSPITYSTYG KFLADGGCSGGAYDIIICDECHSTDATSILGIGTV-LDQAETAGARLVVLATATPP GSVTVPHPNIEEVALST-TGEIPFYGKAIPLEVIKGGRHLIFCHSKKKCDE-LAAKLV ALGINAVAYYRGLDVSVIPTSGDVVVVATDALMTG-FTGDFDSVIDCNTCVTQT VDFSLDPTFTIETTTLPQ-DAVSRTQRRGRTGRGKPGIYRFVAPGERPSGMFDSSV LCECYDAGCAWYELTPAETTVRLRAYMNTPGLPVC-QDHLEFWEGVFTGLTHID AHFLSQTKQSGENLPYL-VAYQATVCARAQAPPPSWDQMWKCLIRLKPTLHGPT PLLYRLGAVQNEVTLTHPITKYIMTCMSADLEV-VTSTWVLVGGVLAALAAYCL STGCVVIVGRIVLS-GKPAIIPDREVLYREFDEMEECSQHLPYIEQGMM-LAEQFKQ KALGLLQTASRQAEVIAPAVQTNWQKLEAFWAKHM-WNFISGIQYLAGLSTLPG NPAIASLMA-FTAAVTSPLTTSQTLLFNILGGWVAAQLAAP-GAATAFVGAGLAGA AIGSVGLGKVLVDILAGYGAGVAGALVAFKIMS-GEVPSTEDLVNLLPAILSPGAL VVGVVCAAILR-RHVGPGEGAVQWMNRLIAFASRGNHVSPTHYVPES-DAAARV TAILSSLTVTQLLRRLHQWISSECTTPCSGSWLRDI-WDWICEVLSDFKTWLKAKL MPQLPGIPFVSCQR-GYRGVWRGDGIMHTRCHCGAEITGHVKNGTM-RIVGPRTC RNMWSGTFPINAYTTGPCTPLPAPNYTFALWRV-SAEEYVEIRQVGDFHYVTGM TTDNLKCPCQVPSP-EFFTELDGVRLHRFAPPCKPLLREEVSFRVGL-HEYPVGSQL PCEPEPDVAVLTSMLTDPSHITAEAAGRRLARGSPPS-VASSSASQLSAPSLKATCT ANHDSPDAELIEANLL-WRQEMGGNITRVESENKVVILDSFDPLVAEEDER-EISVP AEILRKSRRFAPALPIWARPDYNPPLLETWKKPDYEP-PVVHGCPLPPPQSPPVPPP RKKRTVVLTESTVSTA-LAELATKSFGSSSTSGITGDNTTTSSEPAPSGCPPDS-DAE SYSSMPPLEGEPGDPDLSDGSWSTVSSEADTEDV-VCCSMSYSWTGALVTPCAAE EQKLPINALSNSLL-RHHNLVYSTTSRSACQRQKKVTFDRLQVLDSHYQD-VLKEV KAAASKVKANLLSVEEACSLTPPHSAKSKFGY-GAKDVRCHARKAVNHINSVW KDLLEDSVTPIDTTI-MAKNEVFCVQPEKGGRKPARLIVFPDLGVRVCEK-MALYD VVSKLPLAVMGSSYGFQYSPGQRVEFLVQAWKSKK-TPMGFSYDTRCFDSTVTE SDIRTEEAIYQCCDLD-PQARVAIKSLTERLYVGGPLTNSRGENCGYRRCRAS-GVL TTSCGNTLTCYIKARAACRAAGLQDCTMLVCG NNLVVICESAGVQEDAASLRA FTEAMTRYSAPPGDP-PQPEYDLELITSCSSNVSVAHDGAGKRVYYLTRDPTT-PLA RAAWETARHTPVNSWLGNIIMFAPTLWARM-ILMTHFFSVLIARDQLEQALDCEI YGACYSIEPLDLPPIIQRLHGLSAFSLHSYSPGEIN-RVAACLRKLGVPPLRAWRHR ARSVRARLLSRG-GRAAICGKYLFNWAVRTKLKLTPIAAAGQLDLSGW-FTAGYS GGDIYHSVSHARPRWFWFCLLLLAAGVGIYLLPNR (SEQ ID NO:13); and has a length of 1985 amino acids. Such a polytope can include T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10, NS5a-1, NS5a-2, NS5b-1, NS5b-2 in FIGS. 13A-13B and FIGS. 15A-15N.

Additional T-Cell Epitopes

As discussed above, an E1/E2 a heterodimeric polypeptide of the present disclosure includes: a) an HCV E1 polypeptide; and b) a variant HCV E2 polypeptide comprising: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide comprises one or more T cell epitopes present in: a) cholera toxin; and/or b) tetanus toxin; and/or c) diphtheria toxin.

Thus, in some cases, a variant HCV polypeptide of an E1/E2 heterodimer of the present disclosure includes: a) an HCV E2 polypeptide; and b) a heterologous polypeptide that comprises one or more T-cell epitopes, where the one or more T-cell epitopes are T-cell epitopes present in: i) one or more of an HCV NS3 polypeptide, an HCV NS2 polypeptide, an HCV NS4A polypeptide, an HCV NS4B polypeptide, an HCV NS5A polypeptide, an HCV NS5B polypeptide, an HCV core polypeptide, and an HCV p7 polypeptide; and ii) one or more of cholera toxin or toxoid, tetanus toxin or toxoid, diphtheria toxin or toxoid, and a meningococcal outer membrane protein.

In some cases, a heterologous polypeptide can comprise a tetanus toxin T-cell epitope. In some cases, a suitable heterologous polypeptide comprising a tetanus toxin T-cell epitope comprises the amino acid sequence: ILMQYIKAN-SKFIGI (SEQ ID NO:16); and has a length of from 15 amino acids to 20 amino acids. In some cases, a suitable heterologous polypeptide comprising a tetanus toxin T-cell epitope comprises the amino acid sequence: VNNESSE (SEQ ID NO: 17). In some cases, a suitable heterologous polypeptide comprising a tetanus toxin T-cell epitope comprises the amino acid sequence: PGINGKAIHLVNNESSE (SEQ ID NO: 18). In some cases, a suitable heterologous polypeptide comprising a tetanus toxin T-cell epitope comprises the amino acid sequence: PNRDIL (SEQ ID NO: 19). In some cases, a suitable heterologous polypeptide comprising a tetanus toxin T-cell epitope comprises the amino acid sequence: FIGITEL (SEQ ID NO:20). In some cases, a suitable tetanus toxin T-cell epitope comprises the amino acid sequence: SYFPSV (SEQ ID NO:21). In some cases, a suitable heterologous polypeptide comprising a tetanus toxin T-cell epitope comprises the amino acid sequence: NSVDDALINSTKIYSYFPSV (SEQ ID NO:22). In some cases, a suitable heterologous polypeptide comprising a tetanus toxin T-cell epitope comprises the amino acid sequence: IDKISDVSTIVPYIGPALNI (SEQ ID NO:23).

In some cases, a heterologous polypeptide can comprise a diphtheria toxin T-cell epitope In some cases, a suitable heterologous polypeptide comprising a diphtheria toxin T-cell epitope comprises the amino acid sequence: QSIALSSLMVAQAIP (SEQ ID NO:24); and has a length of from 15 amino acids to 20 amino acids. In some cases, a suitable heterologous polypeptide comprising a diphtheria toxin T-cell epitope comprises the amino acid sequence: PVFAGANYAAWAVNVAQVI (SEQ ID NO:25). In some cases, a suitable heterologous polypeptide comprising a diphtheria toxin T-cell epitope comprises the amino acid sequence: VHHNTEEIVAQSIALSSLMV (SEQ ID NO:26). In some cases, a suitable heterologous polypeptide comprising a diphtheria toxin T-cell epitope comprises the amino acid sequence: QSIALSSLMVAQAIPLVGEL (SEQ ID NO:66). In some cases, a suitable heterologous polypeptide comprising a diphtheria toxin T-cell epitope comprises the amino acid sequence: VDIGFAAYNFVESIINLFQV (SEQ ID NO:67). In some cases, a suitable heterologous polypeptide comprising a diphtheria toxin T-cell epitope comprises the amino acid sequence: QGESGHDIKITAENTPLPIA (SEQ ID NO:68). In some cases, a suitable heterologous polypeptide comprising a diphtheria toxin T-cell epitope comprises the amino acid sequence: GVLLPTIPGKLD-VNKSKTHI (SEQ ID NO:69).

In some cases, a heterologous polypeptide can comprise a tetanus toxin T-cell epitope and a diphtheria toxin T-cell epitope. In some of these cases, the heterologous polypeptide can comprise the amino acid sequence: IMQYIKAN-SKFIGIQSIALSSLMVAQ (SEQ ID NO:28); and can have a length of from 26 amino acids to 30 amino acids.

Additional Polypeptides

In any of the above-described embodiments, the variant E2 polypeptide can include one or more additional polypeptides. For example, in some cases, the variant E2 polypeptide includes an Ig Fc polypeptide at the C-terminus of variant E2 polypeptide. As another example, in some cases, the variant E2 polypeptide includes an Ig Fc polypeptide at the N-terminus of variant E2 polypeptide. Ig Fc polypeptides are known in the art, and are described elsewhere herein.

III. Variant E1 Polypeptides

The present disclosure provides a variant HCV E1 polypeptide that comprises: a) an HCV E1 polypeptide; and b) a heterologous polypeptide that comprises one or more T-cell epitopes (e.g., one or more T cell epitopes present in an HCV polypeptide other than an HCV E1 polypeptide or an HCV E2 polypeptide). The heterologous polypeptide is also referred to as a "polytope." A variant E1 polypeptide of the present disclosure is useful for including in an E1/E2 heterodimer of the present disclosure.

The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein. In some cases, a variant HCV E1 polypeptide of the present disclosure includes: a) an HCV E1 polypeptide; and b) a heterologous polypeptide that comprises one or more T-cell epitopes, where the one or more T-cell epitopes are T-cell epitopes present in: i) one or more of an HCV NS3 polypeptide, an HCV NS2 polypeptide, an HCV NS4A polypeptide, an HCV NS4B polypeptide, an HCV NS5A polypeptide, an HCV NS5B polypeptide, an HCV core polypeptide, and an HCV p7 polypeptide; and ii) one or more of cholera toxin or toxoid, tetanus toxin or toxoid, diphtheria toxin or toxoid, and a meningococcal outer membrane protein.

In some cases, the variant HCV E1 polypeptide comprises, in order from N-terminus to C-terminus: i) an HCV E1 polypeptide; and ii) a heterologous polypeptide comprising one or more T cell epitopes. In some cases, the variant HCV E1 polypeptide comprises, in order from N-terminus to C-terminus: i) a heterologous polypeptide comprising one or more T cell epitopes; and ii) an HCV E1 polypeptide.

E1

An HCV E1 polypeptide suitable for inclusion in a variant E1 polypeptide of the present disclosure can have a length of from about 150 amino acids (aa) to about 175 aa, from about 175 aa to about 195 aa, from about 131 aa to about 175 aa, or from about 175 aa to about 193 aa. The E1 polypeptide can be a full-length HCV E1 polypeptide. The E1 polypeptide can be an HCV E1 ectodomain polypeptide.

In FIGS. 1A-1C, the amino acid sequence of E1 is amino acid 192 to amino acid 383. In FIGS. 2A-2C, the amino acid sequence of E1 is amino acid 192 to amino acid 383. In FIGS. 3A-3C, the amino acid sequence of E1 is amino acid 192 to amino acid 384. In FIGS. 4A-4B, the amino acid sequence of E1 is amino acid 192 to amino acid 383. Amino acids at around 170 through approximately 191 serve as a signal sequence for E1. As used herein, "E1 polypeptide" includes a precursor E1 protein, including the signal sequence; includes a mature E1 polypeptide which lacks this sequence; and includes an E1 polypeptide with a heterologous signal sequence. An E1 polypeptide can include a C-terminal membrane anchor sequence which occurs at approximately amino acid positions 360-383 (see, e.g., WO 96/04301). In some cases, a suitable E1 polypeptide lacks a C-terminal portion that includes a transmembrane region. For example, in some cases, a suitable E1 polypeptide lacks the C-terminal portion from amino acid 330 to amino acid 384, or from amino acid 360 to amino acid 384. E1 polypeptides can be an E1 polypeptide of any genotype, subtype or isolate of HCV. E1 polypeptides of genotype 1 and E1 polypeptides of genotype 3 are included in an E1/E2 heterodimer of the present disclosure.

An E1 polypeptide suitable for inclusion in a variant E1 polypeptide of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIGS. 1A-1C, FIGS. 2A-2C, FIGS. 3A-3C, or FIGS. 4A-4B.

An E1 polypeptide suitable for inclusion in a variant E1 polypeptide of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIGS. 1A-1C. For example, an E1 polypeptide of genotype 1A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 1A and depicted in FIGS. 1A-1C. For example, an E1 polypeptide of genotype 1B can comprise an amino acid sequence having having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 1B and depicted in FIGS. 1A-1C. For example, an E1 polypeptide of genotype 1C can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 1C and depicted in FIGS. 1A-1C.

An E1 polypeptide suitable for inclusion in a variant E1 polypeptide of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIGS. 2A-2C. For example, an E1 polypeptide of genotype 2A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 2A and depicted in FIGS. 2A-2C. For example, an E1 polypeptide of genotype 2B can comprise an amino acid sequence having having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 2B and depicted in FIGS. 2A-2C.

An E1 polypeptide suitable for inclusion in a variant E1 polypeptide of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the consensus E1 polypeptide amino acid sequence depicted in FIGS. 3A-3C.

An E1 polypeptide suitable for inclusion in a variant E1 polypeptide of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIGS. 4A-4B. For example, an E1 polypeptide of genotype 7A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of the amino acid sequence depicted in FIGS. 4A-4B.

Heterologous Polypeptide

The heterologous polypeptide present in an E1 variant polypeptide of the present disclosure includes one or more T-cell epitopes.

In some cases, the heterologous polypeptide comprises 1, 2, 3, 4, 5, 6, 7, 8, 9, or 10, or more than 10 (e.g., from 10 to 15, from 15 to 20, from 20 to 25, or from 25 to 30, or more than 30), T cell epitopes. T-cell epitopes are epitopes that, when presented with a major histocompatibility complex (MHC) (e.g., a human leukocyte antigen (HLA)) Class I or MHC Class II molecule, are recognized and bound by a T-cell receptor (TCR) present on a T cell surface. T-cell epitopes include epitopes recognized by cytotoxic T cells (e.g., CD8$^+$ T cells), and epitopes recognized by helper T cells (e.g., CD4$^+$ T cells).

The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein. Other examples of strong T helper epitopes are diphtheria toxoid, tetanus toxoid, meningococcal outer membrane protein, or mutant diphtheria protein CRM197 (see, e.g.: www(dot)medscape(dot)com/viewarticle/431127).

In some cases, the heterologous polypeptide comprises a single T-cell epitope. In some cases, the heterologous polypeptide comprises a single HCV-NS3 T-cell epitope. In some cases, the heterologous polypeptide comprises 2 or more T-cell epitopes. In some cases, the heterologous polypeptide comprises 2 or more HCV-NS3 T-cell epitopes. In some cases, the heterologous polypeptide comprises 3 or more HCV-NS3 T-cell epitopes. In some cases, the heterologous polypeptide comprises 4 or more HCV-NS3 T-cell epitopes. In some cases, the heterologous polypeptide comprises a single HCV-NS3 CD4$^+$ T-cell epitope. In some cases, the heterologous polypeptide comprises 2 or more HCV-NS3 CD4$^+$ T-cell epitopes. In some cases, the heterologous polypeptide comprises one or more HCV CD8$^+$ T cell epitopes. In some cases, the heterologous polypeptide comprises a single HCV-NS3 CD8$^+$ T-cell epitope. In some cases, the heterologous polypeptide comprises 2 or more HCV-NS3 CD8$^+$ T-cell epitopes. In some cases, the heterologous polypeptide comprises at least one HCV CD4$^+$ T cell epitope and at least one HCV CD8$^+$ T cell epitope. In some cases, the heterologous polypeptide comprises at least one HCV-NS3 CD4$^+$ T cell epitope and at least one HCV-NS3 CD8$^+$ T cell epitope. In some cases, heterologous polypeptide comprises 2 or more HCV-NS3 CD4$^+$ T-cell epitopes and 2 or more HCV-NS3 CD8$^+$ T-cell epitopes. In some cases, the heterologous polypeptide comprises 2, 3, 4, or 5 HCV-NS3 CD4$^+$ T-cell epitopes and 2, 3, 4, or 5 HCV-NS3 CD8$^+$ T-cell epitopes.

In some cases, the heterologous polypeptide comprises a single T-cell epitope. In some cases, the heterologous polypeptide comprises a single HCV-NS2 T-cell epitope. In some cases, the heterologous polypeptide comprises 2 or more T-cell epitopes. In some cases, the heterologous polypeptide comprises 2 or more HCV-NS2 T-cell epitopes. In some cases, the heterologous polypeptide comprises 3 or more HCV-NS2 T-cell epitopes. In some cases, the heterologous polypeptide comprises 4 or more HCV-NS2 T-cell epitopes. In some cases, the heterologous polypeptide comprises a single HCV-NS2 CD4$^+$ T-cell epitope. In some cases, the heterologous polypeptide comprises 2 or more HCV-NS2 CD4$^+$ T-cell epitopes. In some cases, the heterologous polypeptide comprises one or more HCV CD8$^+$ T cell epitopes. In some cases, the heterologous polypeptide comprises a single HCV-NS2 CD8$^+$ T-cell epitope. In some cases, the heterologous polypeptide comprises 2 or more HCV-NS2 CD8$^+$ T-cell epitopes. In some cases, the heterologous polypeptide comprises at least one HCV CD4$^+$ T cell epitope and at least one HCV CD8$^+$ T cell epitope. In some cases, the heterologous polypeptide comprises at least one HCV-NS2 CD4$^+$ T cell epitope and at least one HCV-NS2 CD8$^+$ T cell epitope. In some cases, heterologous polypeptide comprises 2 or more HCV-NS2 CD4$^+$ T-cell epitopes and 2 or more HCV-NS2 CD8$^+$ T-cell epitopes. In some cases, the heterologous polypeptide comprises 2, 3, 4, or 5 HCV-NS2 CD4$^+$ T-cell epitopes and 2, 3, 4, or 5 HCV-NS2 CD8$^+$ T-cell epitopes.

In some cases, the heterologous polypeptide comprises a single T-cell epitope. In some cases, the heterologous polypeptide comprises a single HCV-NS4A T-cell epitope. In some cases, the heterologous polypeptide comprises 2 or more T-cell epitopes. In some cases, the heterologous polypeptide comprises 2 or more HCV-NS4A T-cell epitopes. In some cases, the heterologous polypeptide comprises 3 or more HCV-NS4A T-cell epitopes. In some cases, the heterologous polypeptide comprises 4 or more HCV-NS4A T-cell epitopes. In some cases, the heterologous polypeptide comprises a single HCV-NS4A CD4$^+$ T-cell epitope. In some cases, the heterologous polypeptide comprises 2 or more HCV-NS4A CD4$^+$ T-cell epitopes. In some cases, the heterologous polypeptide comprises one or more HCV CD8$^+$ T cell epitopes. In some cases, the heterologous polypeptide comprises a single HCV-NS4A CD8$^+$ T-cell epitope. In some cases, the heterologous polypeptide comprises 2 or more HCV-NS4A CD8$^+$ T-cell epitopes. In some cases, the heterologous polypeptide comprises at least one HCV CD4$^+$ T cell epitope and at least one HCV CD8$^+$ T cell epitope. In some cases, the heterologous polypeptide comprises at least one HCV-NS4A CD4⁺ T cell epitope and at least one HCV-NS4A CD8⁺ T cell epitope. In some cases, heterologous polypeptide comprises 2 or more HCV-NS4A CD4⁺ T-cell epitopes and 2 or more HCV-NS4A CD8⁺ T-cell epitopes. In some cases, the heterologous polypeptide comprises 2, 3, 4, or 5 HCV-NS4A CD4⁺ T-cell epitopes and 2, 3, 4, or 5 HCV-NS4A CD8⁺ T-cell epitopes.

In some cases, the heterologous polypeptide comprises a single T-cell epitope. In some cases, the heterologous polypeptide comprises a single HCV-NS5A T-cell epitope. In some cases, the heterologous polypeptide comprises 2 or more T-cell epitopes. In some cases, the heterologous polypeptide comprises 2 or more HCV-NS5A T-cell epitopes. In some cases, the heterologous polypeptide comprises 3 or more HCV-NS5A T-cell epitopes. In some cases, the heterologous polypeptide comprises 4 or more HCV-NS5A T-cell epitopes. In some cases, the heterologous polypeptide comprises a single HCV-NS5A CD4⁺ T-cell epitope. In some cases, the heterologous polypeptide comprises 2 or more HCV-NS5A CD4⁺ T-cell epitopes. In some cases, the heterologous polypeptide comprises one or more HCV CD8⁺ T cell epitopes. In some cases, the heterologous polypeptide comprises a single HCV-NS5A CD8⁺ T-cell epitope. In some cases, the heterologous polypeptide comprises 2 or more HCV-NS5A CD8⁺ T-cell epitopes. In some cases, the heterologous polypeptide comprises at least one HCV CD4⁺ T cell epitope and at least one HCV CD8⁺ T cell epitope. In some cases, the heterologous polypeptide comprises at least one HCV-NS5A CD4⁺ T cell epitope and at least one HCV-NS5A CD8⁺ T cell epitope. In some cases, heterologous polypeptide comprises 2 or more HCV-NS5A CD4⁺ T-cell epitopes and 2 or more HCV-NS5A CD8⁺ T-cell epitopes. In some cases, the heterologous polypeptide comprises 2, 3, 4, or 5 HCV-NS5A CD4⁺ T-cell epitopes and 2, 3, 4, or 5 HCV-NS5A CD8⁺ T-cell epitopes.

In some cases, the heterologous polypeptide comprises a single T-cell epitope. In some cases, the heterologous polypeptide comprises a single HCV-NS5B T-cell epitope. In some cases, the heterologous polypeptide comprises 2 or more T-cell epitopes. In some cases, the heterologous polypeptide comprises 2 or more HCV-NS5B T-cell epitopes. In some cases, the heterologous polypeptide comprises 3 or more HCV-NS5B T-cell epitopes. In some cases, the heterologous polypeptide comprises 4 or more HCV-NS5B T-cell epitopes. In some cases, the heterologous polypeptide comprises a single HCV-NS5B CD4⁺ T-cell epitope. In some cases, the heterologous polypeptide comprises 2 or more HCV-NS5B CD4⁺ T-cell epitopes. In some cases, the heterologous polypeptide comprises one or more HCV CD8⁺ T cell epitopes. In some cases, the heterologous polypeptide comprises a single HCV-NS5B CD8⁺ T-cell epitope. In some cases, the heterologous polypeptide comprises 2 or more HCV-NS5B CD8⁺ T-cell epitopes. In some cases, the heterologous polypeptide comprises at least one HCV CD4⁺ T cell epitope and at least one HCV CD8⁺ T cell epitope. In some cases, the heterologous polypeptide comprises at least one HCV-NS5B CD4⁺ T cell epitope and at least one HCV-NS5B CD8⁺ T cell epitope. In some cases, heterologous polypeptide comprises 2 or more HCV-NS5B CD4⁺ T-cell epitopes and 2 or more HCV-NS5B CD8⁺ T-cell epitopes. In some cases, the heterologous polypeptide comprises 2, 3, 4, or 5 HCV-NS5B CD4⁺ T-cell epitopes and 2, 3, 4, or 5 HCV-NS5B CD8⁺ T-cell epitopes.

In some cases, the heterologous polypeptide comprises a single T-cell epitope. In some cases, the heterologous polypeptide comprises a single HCV-core T-cell epitope. In some cases, the heterologous polypeptide comprises 2 or more T-cell epitopes. In some cases, the heterologous polypeptide comprises 2 or more HCV-core T-cell epitopes. In some cases, the heterologous polypeptide comprises 3 or more HCV-core T-cell epitopes. In some cases, the heterologous polypeptide comprises 4 or more HCV-core T-cell epitopes. In some cases, the heterologous polypeptide comprises a single HCV-core CD4⁺ T-cell epitope. In some cases, the heterologous polypeptide comprises 2 or more HCV-core CD4⁺ T-cell epitopes. In some cases, the heterologous polypeptide comprises one or more HCV CD8⁺ T cell epitopes. In some cases, the heterologous polypeptide comprises a single HCV-core CD8⁺ T-cell epitope. In some cases, the heterologous polypeptide comprises 2 or more HCV-core CD8⁺ T-cell epitopes. In some cases, the heterologous polypeptide comprises at least one HCV CD4⁺ T cell epitope and at least one HCV CD8⁺ T cell epitope. In some cases, the heterologous polypeptide comprises at least one HCV-core CD4⁺ T cell epitope and at least one HCV-core CD8⁺ T cell epitope. In some cases, heterologous polypeptide comprises 2 or more HCV-core CD4⁺ T-cell epitopes and 2 or more HCV-core CD8⁺ T-cell epitopes. In some cases, the heterologous polypeptide comprises 2, 3, 4, or 5 HCV-core CD4⁺ T-cell epitopes and 2, 3, 4, or 5 HCV-core CD8⁺ T-cell epitopes.

In some cases, the heterologous polypeptide comprises a single T-cell epitope. In some cases, the heterologous polypeptide comprises a single HCV-p7 T-cell epitope. In some cases, the heterologous polypeptide comprises 2 or more T-cell epitopes. In some cases, the heterologous polypeptide comprises 2 or more HCV-p7 T-cell epitopes. In some cases, the heterologous polypeptide comprises 3 or more HCV-p7 T-cell epitopes. In some cases, the heterologous polypeptide comprises 4 or more HCV-p7 T-cell epitopes. In some cases, the heterologous polypeptide comprises a single HCV-p7 CD4⁺ T-cell epitope. In some cases, the heterologous polypeptide comprises 2 or more HCV-core CD4⁺ T-cell epitopes. In some cases, the heterologous polypeptide comprises one or more HCV CD8⁺ T cell epitopes. In some cases, the heterologous polypeptide comprises a single HCV-p7 CD8⁺ T-cell epitope. In some cases, the heterologous polypeptide comprises 2 or more HCV-p7 CD8⁺ T-cell epitopes. In some cases, the heterologous polypeptide comprises at least one HCV CD4⁺ T cell epitope and at least one HCV CD8⁺ T cell epitope. In some cases, the heterologous polypeptide comprises at least one HCV-p7 CD4⁺ T cell epitope and at least one HCV-p7 CD8⁺ T cell epitope. In some cases, heterologous polypeptide comprises 2 or more HCV-p7 CD4⁺ T-cell epitopes and 2 or more HCV-p7 CD8⁺ T-cell epitopes. In some cases, the heterologous polypeptide comprises 2, 3, 4, or 5 HCV-p7 CD4⁺ T-cell epitopes and 2, 3, 4, or 5 HCV-p7 CD8⁺ T-cell epitopes.

In some cases, the heterologous polypeptide comprises 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, or 63, of the T-cell epitopes set out in FIGS. 13A-13B. In some cases, the heterologous polypeptide comprises from 1 to 3, from 3 to 5, from 5 to 10, from 10 to 15, from 15 to 20, from 20 to 25, or from 25 to 30 of the T-cell epitopes set out in FIGS. 13A-13B. For example, in some cases, the heterologous polypeptide comprises the T-cell epitopes designated NS3-3, NS3-4, and NS3-11 in FIGS. 13A-13B and FIGS. 15A-15N. As another example, in some cases, the heterologous polypeptide comprises the T-cell epitopes designated NS2-1, NS2-2, NS2-3, NS2-7, and NS2-8 in FIGS. 13A-13B and FIGS. 15A-15N. As another example, in some cases, the heterologous polypeptide comprises the T-cell epitopes designated NS3-3, NS3-4, NS3-5, and NS3-11 in FIGS. 13A-13B and FIGS. 15A-15N. As another example, in some cases, the heterologous polypeptide comprises the T-cell epitopes designated NS3-3, NS3-4, NS3-5, NS3-6, NS3-7, NS3-11, NS3-12, and NS3-13 in FIGS. 13A-13B and FIGS. 15A-15N. As another example, in some cases, the heterologous polypeptide comprises the T-cell epitopes designated NS3-3, NS3-4, NS3-5, NS3-6, NS3-7, NS3-10, NS3-11, NS3-12, and NS3-13 in FIGS. 13A-13B and FIGS. 15A-15N. As another example, in some cases, the heterologous polypeptide comprises the T-cell epitopes designated Core-1, Core-2, Core-3, Core-4, Core-5, Core-6, Core-7, Core-8, Core-9, Core-10, Core-11, Core-12, Core-13, Core-14, Core-16, Core-17, Core-18, Core-19, Core-20, Core-21, and Core-22 in FIGS. 13A-13B and FIGS. 15A-15N. As another example, in some cases, the heterologous polypeptide comprises the T-cell epitopes designated NS3-1, NS3-2, NS3-3, NS3-4, NS3-5, NS3-6, NS3-7, NS3-9, NS3-10, NS3-11, NS3-12, and NS3-13 in FIGS. 13A-13B and FIGS. 15A-15N. As another example, in some cases, the heterologous polypeptide comprises the T-cell epitopes designated NS2-1, NS2-2, NS2-3, NS2-4, NS2-5, NS2-6, NS2-7, NS2-8, NS3-1, NS3-2, NS3-3, NS3-4, NS3-5, NS3-6, NS3-7, NS3-9, NS3-10, NS3-11, NS3-12, and NS3-13 in FIGS. 13A-13B and FIGS. 15A-15N. As another example, in some cases, the heterologous polypeptide comprises the T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, and NS4b-10 in FIGS. 13A-13B and FIGS. 15A-15N. As another example, in some cases, the heterologous polypeptide comprises the T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10, NS5a-1, NS5a-2, NS5b-1, and NS5b-2 in FIGS. 13A-13B and FIGS. 15A-15N. In some cases, the T-cell epitopes are contiguous. In some cases, any two T-cell epitopes are separated by linkers (e.g., a linker having a length of from 1 amino acid to about 50 amino acids, e.g., from 1 amino acid to 5 amino acids (aa), from 5 aa to 10 aa, from 10 aa to 15 aa, from 15 aa to 20 aa, from 20 aa to 25 aa, from 25 aa to 30 aa, from 30 aa to 40 aa, or from 40 aa to 50 aa).

In some cases, the heterologous polypeptide comprises at least one HCV CD4+ T cell epitope and at least one HCV CD8+ T cell epitope, where epitopes are conserved among HCV genotypes 1 and 2. In some cases, the heterologous polypeptide comprises at least one HCV CD4+ T cell epitope and at least one HCV CD8+ T cell epitope, where epitopes are conserved among HCV genotypes 1 and 3. In some cases, the heterologous polypeptide comprises at least one HCV CD4+ T cell epitope and at least one HCV CD8+ T cell epitope, where epitopes are conserved among HCV genotypes 1, 2, and 3. In some cases, the heterologous polypeptide comprises at least one HCV CD4+ T cell epitope and at least one HCV CD8+ T cell epitope, where epitopes are conserved among HCV genotypes 1, 2, 3, and 7. In some cases, the heterologous polypeptide comprises at least one HCV CD4+ T cell epitope and at least one HCV CD8+ T cell epitope, where epitopes are conserved among HCV genotypes 1-7.

The heterologous polypeptide can have a length of from about 10 amino acids to about 2000 amino acids; e.g., the heterologous polypeptide can have a length of from 10 amino acids (aa) to 15 aa, from 15 aa to 20 aa, from 20 aa to 25 aa, from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The heterologous polypeptide can have a length of from about 25 amino acids to about 2000 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 500 aa, from 500 aa to 600 aa, from 600 aa to 700 aa, from 700 aa to 800 aa, from 800 aa to 900 aa, from 900 aa to 1000 aa, from 1000 aa to 1100 aa, from 1100 aa to 1200 aa, from 1200 aa to 1300 aa, from 1300 aa to 1400 aa, from 1400 aa to 1500 aa, from 1500 aa to 1600 aa, from 1600 aa to 1700 aa, from 1700 aa to 1800 aa, from 1800 aa to 1900 aa, or from 1900 aa to 2000 aa. The heterologous polypeptide can have a length of from about 25 amino acids to about 3000 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 500 aa, from 500 aa to 600 aa, from 600 aa to 700 aa, from 700 aa to 800 aa, from 800 aa to 900 aa, from 900 aa to 1000 aa, from 1000 aa to 1100 aa, from 1100 aa to 1200 aa, from 1200 aa to 1300 aa, from 1300 aa to 1400 aa, from 1400 aa to 1500 aa, from 1500 aa to 1600 aa, from 1600 aa to 1700 aa, from 1700 aa to 1800 aa, from 1800 aa to 1900 aa, from 1900 aa to 2000 aa, from 2000 aa to 2250 aa, from 2250 aa to 2500 aa, from 2500 aa to 2750 aa, or from 2750 aa to 3000 aa.

The heterologous polypeptide can have a length of from about 25 amino acids to about 800 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The heterologous polypeptide can have a length of from about 25 amino acids to about 400 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, or from 350 aa to 400 aa. The heterologous polypeptide can have a length of 25 amino acids (aa), 26 aa, 27 aa, 28 aa, 29 aa, 30 aa, 31 aa, 32 aa, 33 aa, 34 aa, 35 aa, 36 aa, 37 aa, 38 aa, 39 aa, 40 aa, 41 aa, 42 aa, 43 aa, 44 aa, 45 aa, 46 aa, 47 aa, 48 aa, 49 aa, or 50 aa. The heterologous polypeptide can have a length of from about 100 amino acids (aa) to 800 aa, e.g., from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The heterologous polypeptide can have a length of from 25 aa to 30 aa. The heterologous polypeptide can have a length of from 30 aa to 40 aa. The heterologous polypeptide can have a length of from 40 aa to 50 aa. The heterologous polypeptide can have a length of from 50 aa to 60 aa (e.g., 50 aa, 51 aa, 52, aa, 53 aa, 54 aa, 55 aa, 56 aa, 57 aa, 58 aa, 59 aa, or 60 aa). The heterologous polypeptide can have a length of from 60 aa to 70 aa. The heterologous polypeptide can have a length of from 65 aa to 75 aa (e.g., 65, 66, 67, 68, 69, 70, 71, 72, 7, 74, or 75 aa). The heterologous polypeptide can have a length of 70 aa. The heterologous polypeptide can have a length of from 70 aa to 80 aa. The heterologous polypeptide can have a length of from 80 aa to 90 aa. The heterologous polypeptide can have a length of from 90 aa to 100 aa. The heterologous polypeptide can have a length of from 100 aa to 105 aa (e.g., 100, 101, 102, 103, 104, 105, 106, 107, 108, 109, or 110 aa). The heterologous polypeptide can have a length of 100 aa. The heterologous polypeptide can have a length of from 10 amino acids (aa) to 50 aa; e.g., from 10 aa to 15 aa, from 15 aa to 20 aa, from 20 aa to 25 aa, from 25 aa to 30 aa, from 30 aa to 35 aa, from 35 aa to 40 aa, from 40 aa to 45 aa, or from 45 aa to 50 aa. The heterologous polypeptide can have a length of from 10 amino acids (aa) to 20 aa, e.g., 10, 11, 12, 13, 14, 15, 16, 17, 18, 19, or 20 aa.

HCV NS3 T-Cell Epitopes

In some cases, the heterologous polypeptide present in an E2 variant polypeptide of an E1/E2 heterodimer of the present disclosure includes one or more T-cell epitopes present in an HCV NS3 polypeptide. Examples of T-cell epitopes present in NS3 polypeptides are depicted in FIGS. 15A-15N, FIG. 13B, and FIGS. 14A-14B.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKL (SEQ ID NO: 1). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKL (SEQ ID NO: 1); and has a length of from 25 aa to 35 aa (e.g., 25 aa, 26 aa, 27 aa, 28 aa, 29 aa, 30 aa, 31 aa, 32 aa, 33 aa, 34 aa, or 35 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKG-GRHLIFCHSKKKCDELAAKL (SEQ ID NO: 1); and has a length of 29 amino acids. Such a polytope can include NS3 T-cell epitopes designated NS3-3, NS3-4, and NS3-11 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKLVALGI-NAVAYYRGLDVSVIPTSG (SEQ ID NO:2). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKLVALGI-NAVAYYRGLDVSVIPTSG (SEQ ID NO:2); and has a length of from 45 amino acids to 60 amino acids (e.g., 45 aa, 46 aa, 47 aa, 48 aa, 49 aa, 50 aa, 51 aa, 52 aa, 53 aa, 54 aa, 55 aa, 56 aa, 57 aa, 58 aa, 59 aa, or 60 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKLVALGI-NAVAYYRGLDVSVIPTSG (SEQ ID NO:2); and has a length of 52 amino acids. Such a polytope can include NS3 T-cell epitopes designated NS3-3, NS3-4, NS3-5, and NS3-11 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: KGGRHLIFCHSKKKCDELAAKLVALGINAVAYYR-GLDVSVIPTSGDVVVVATDALMTG FTGDFDSVIDCN (SEQ ID NO:3); and has a length of from 65 amino acids to 80 amino acids (e.g., 65 aa, 66 aa, 67 aa, 68 aa, 69 aa, 70 aa, 71 aa, 72 aa, 73 aa, 74 aa, 75 aa, 76 aa, 77 aa, 78 aa, 79 aa, or 80 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: KGGRHLIFCHSKKKCDE-LAAKLVALGINAVAYYRGLDVSVIPTSGDVVVVAT-DALMTG FTGDFDSVIDCN (SEQ ID NO:3); and has a length of 70 amino acids. Such a polytope can include NS3 T-cell epitopes designated NS3-3, NS3-4, NS3-5, NS3-6, NS3-7, NS3-11, NS3-12, and NS3-13 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: VALSTTGEIPFYGKAIPLEVIKGGRHLIFCHSKK-KCDELAAKLVALGINAVAYYRGLDVS VIPTSGDV-VVVATDALMTGFTGDFDSVIDCNTCVTQTVDF (SEQ ID NO:4); and has a length of from 95 amino acids (aa) to 105 aa (e.g., 95 aa, 96 aa, 97 aa, 98 aa, 99 aa, 100 aa, 101 aa, 102 aa, 103 aa, 104 aa, or 105 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: VALSTT-GEIPFYGKAIPLEVIKGGRHLIFCHSKKKCDELAAK-LVALGINAVAYYRGLDVS VIPTSGDVVVVATDALMT-GFTGDFDSVIDCNTCVTQTVDF (SEQ ID NO:4); and has a length of 100 amino acids. Such a polytope can include NS3 T-cell epitopes designated NS3-3, NS3-4, NS3-5, NS3-6, NS3-7, NS3-10, NS3-11, NS3-12, and NS3-13 in FIG. 13B and FIGS. 15A-15N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQIVG-GVYLLPRRGPRLGVRATRKTSERSQP RGRRQPIP-KARRPEGRTWAQPGYPWPLYGNEGCGWAGWLL-SPRGSRPSWGPTDPRRRS RNLGKVIDTLTCGFADLMGYIPLVGAPLGGAARAL-AHGVRVLEDGVNYATGNLPGCSF SIFLLALLSCLTV-PASA (SEQ ID NO:9); and has a length of from 190 amino acids (aa) to 200 aa (e.g., 190 aa, 191 aa, 192 aa, 193 aa, 194 aa, 195 aa, 196 aa, 197 aa, 198 aa, 199 aa, or 200 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQIVG-GVYLLPRRGPRLGVRATRKTSERSQP RGRRQPIP-KARRPEGRTWAQPGYPWPLYGNEGCGWAGWLL-SPRGSRPSWGPTDPRRRS RNLGKVIDTLTCGFADLMGYIPLVGAPLGGAARAL-AHGVRVLEDGVNYATGNLPGCSF SIFLLALLSCLTV-PASA (SEQ ID NO:9); and has a length of 191 amino acids.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence:

```
                                        (SEQ ID NO: 10)
LHAPTGSGKSTKVPAAYAAQGYKVLVLNPSVAATLGFGAYMSKAHGIDPNI

RTGVRTITTGSPITYSTYGKFLADGGCSGGAYDIIICDECHSTDATSILGI

GTVLDQAETAGARLVVLATATPPGSVTVPHPNIEEVALSTTGEIPFYGKAI

PLEVIKGGRHLIFCHSKKKCDELAAKLVALGINAVAYYRGLDVSVIPTSGD

VVVVATDALMTGFTGDFDSVIDCN;
``` and has a length of from 215 amino acids (aa) to 235 aa (e.g., 215 aa, 216 aa, 217 11, 218 aa, 219 aa, 220 aa, 221 aa, 222 aa, 223 aa, 224 aa, 225 aa, 226 aa, 227 aa, 228 aa, 229 aa, 230 aa, 231 aa, 232 aa, 233 aa, 234 aa, or 235 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence:

```
                                        (SEQ ID NO: 10)
LHAPTGSGKSTKVPAAYAAQGYKVLVLNPSVAATLGFGAYMSKAHGIDPNI

RTGVRTITTGSPITYSTYGKFLADGGCSGGAYDIIICDECHSTDATSILGI

GTVLDQAETAGARLVVLATATPPGSVTVPHPNIEEVALSTTGEIPFYGKAI

PLEVIKGGRHLIFCHSKKKCDELAAKLVALGINAVAYYRGLDVSVIPTSGD

VVVVATDALMTGFTGDFDSVIDCN;
``` and has a length of 228 amino acids. Such a polytope can include NS3 T-cell epitopes designate NS3-1, NS3-2, NS3-3, NS3-4, NS3-5, NS3-6, NS3-7, NS3-9, NS3-10, NS3-11, NS3-12, and NS3-13 in FIG. 13B and FIGS. 15A-15N.

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1265-1279 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1309-1323 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1401-1415 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1402-1412 of the amino acid sequence designated "Consensus" in FIGS. 16A-16L, or a corresponding HCV NS3 amino acid sequence of any HCV genotype; and the HCV NS3 T-cell epitope can have a length of from 11 amino acids (aa) to 16 amino acids (e.g., 11 aa, 12 aa, 13 aa, 14 aa, 15 aa, or 16 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1429-1439 of the amino acid sequence designated "Consensus" in FIGS. 16A-16L, or a corresponding HCV NS3 amino acid sequence of any HCV genotype; and the HCV NS3 T-cell epitope can have a length of from 11 amino acids (aa) to 16 amino acids (e.g., 11 aa, 12 aa, 13 aa, 14 aa, 15 aa, or 16 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1450-1464 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1453-1467 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1577-1591 of the amino acid sequence designated "Consensus" in FIGS. 16A-16L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1306-1314 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1387-1394 of the amino acid sequence designated "Consensus" in FIGS. 16A-16L, or a corresponding HCV NS3 amino acid sequence of any HCV genotype; and the HCV NS3 T-cell epitope can have a length of from 1 amino acids (aa) to 15 amino acids (e.g., 8 aa, 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1405-1413 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1450-1458 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1457-1465 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1610-1618 of the amino acid sequence designated "Consensus" in FIGS. 16A-16L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

HCV NS2 T-Cell Epitopes

In some cases, the heterologous polypeptide present in an E2 variant polypeptide of an E1/E2 heterodimer of the present disclosure includes one or more T-cell epitopes present in an HCV NS2 polypeptide. Examples of T-cell epitopes present in NS2 polypeptides are depicted in FIGS. 15A-15N, and FIG. 13A.

For example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 955-974 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 975-994 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 985-1004 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1015-1034 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1035-1054 of the amino acid sequence designated "Consensus" in FIGS. 16A-16L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 924-933 of the amino acid sequence designated "Consensus" in FIGS. 16A-16L, or a corresponding HCV NS2 amino acid sequence of any HCV genotype; and the NS2 T cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 961-970 of the amino acid sequence designated "Consensus" in FIGS. 16A-16L, or a corresponding HCV NS2 amino acid sequence of any HCV genotype; and the NS2 T cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 989-997 of the amino acid sequence designated "Consensus" in FIGS. 16A-16L, or a corresponding HCV NS2 amino acid sequence of any HCV genotype; and the NS2 T cell epitope can have a length of from 9 amino acids (aa) to 15 amino acids (e.g., 9 aa, 10 aa, 11 aa, 12 aa, 13 aa, 14 aa, or 15 aa).

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 50 aa (e.g., from 10 aa to 25 aa, or from 25 aa to 50 aa) of amino acids 955-1004 of the amino acid sequence designated "Consensus" in FIGS. 16A-16L, or a corresponding HCV NS2 amino acid sequence of any HCV genotype; and has a length of from 10 amino acids (aa) to 25 aa, or from 25 aa to 50 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 955-1004 of the amino acid sequence designated "Consensus" in FIGS. 16A-16L, or a corresponding HCV NS2 amino acid sequence of any HCV genotype; and has a length of about 50 amino acids.

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 553 aa (e.g., from 10 aa to 25 aa, from 25 aa to 50 aa, from 50 aa to 100 aa, from 100 aa to 200 aa, from 200 aa to 300 aa, from 300 aa to 400 aa, from 400 aa to 500 aa, or from 500 aa to 553 aa) of amino acids 917-1469 of the amino acid sequence designated "Consensus" in FIGS. 16A-16L, or a corresponding HCV NS2 and NS3 amino acid sequence of any HCV genotype; and has a length of from 10 amino acids (aa) to 25 aa, from 25 aa to 50 aa, from 50 aa to 100 aa, from 100 aa to 200 aa, from 200 aa to 300 aa, from 300 aa to 400 aa, from 400 aa to 500 aa, or from 500 aa to 553 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 917-1469 of the amino acid sequence designated "Consensus" in FIGS. 16A-16L, or a corresponding HCV NS2 and NS3 amino acid sequence of any HCV genotype; and has a length of about 553 amino acids.

The heterologous polypeptide can comprise an amino acid sequence having at least about 20%, at least about 25%, at least about 30%, at least about 35%, at least about 40%, at least about 45%, at least about 50%, at least about 60%, at least about 0%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRDWAHNGLRDLAVAVEPV-VFSQMETKLITWGADT (SEQ ID NO: 11). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRDWAHNGLRDLAVAVEPV-VFSQMETKLITWGADT (SEQ ID NO:11); and has a length of from 50 amino acids to 60 amino acids (e.g., 50 aa, 51 aa, 52 aa, 53 aa, 54 aa, 55 aa, 56 aa, 57 aa, 58 aa, 59 aa, or 60 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRD-WAHNGLRDLAVAVEPVVFSQMETKLITWGADT (SEQ ID NO: 11); and has a length of 50 amino acids. Such a polytope can include NS2 T-cell epitopes designated NS2-1, NS2-2, NS2-3, NS2-7, and NS2-8 in FIG. 13A and FIGS. 15A-15N.

HCV NS4A T-Cell Epitopes

In some cases, the heterologous polypeptide present in an E2 variant polypeptide of an E1/E2 heterodimer of the present disclosure includes one or more T-cell epitopes present in an HCV NS4A polypeptide. Examples of T-cell epitopes present in NS4A polypeptides are depicted in FIGS. 15A-15N and FIG. 13B.

The heterologous polypeptide can comprise an NS4A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1683-1692 of the amino acid sequence designated "Consensus" in FIGS. 16A-16L, or a corresponding HCV NS4A amino acid sequence of any HCV genotype; and the NS4A T-cell epitope can have a length of from 10 amino acids (aa) to 15 amino acids (e.g., 10 aa, 11 aa, 12 aa, 13 aa, 14 aa, or 15 aa).

HCV NS4B T-Cell Epitopes

In some cases, the heterologous polypeptide present in an E2 variant polypeptide of an E1/E2 heterodimer of the present disclosure includes one or more T-cell epitopes present in an HCV NS4B polypeptide. Examples of T-cell epitopes present in NS4B polypeptides are depicted in FIGS. 15A-15N and FIG. 13B.

As one example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1790-1801 of the amino acid sequence designated "Consensus" in FIGS. 16A-16L, or a corresponding HCV NS4B amino acid sequence of any HCV genotype; and the NS4B T-cell epitope can have a length of from 12 amino acids (aa) to 20 amino acids (e.g., 12 aa, 13 aa, 14 aa, 15 aa, 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1792-1802 of the amino acid sequence designated "Consensus" in FIGS. 16A-16L, or a corresponding HCV NS4B amino acid sequence of any HCV genotype; and the NS4B T-cell epitope can have a length of from 11 amino acids (aa) to 20 amino acids (e.g., 11 aa, 12 aa, 13 aa, 14 aa, 15 aa, 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1898-1905 of the amino acid sequence designated "Consensus" in FIGS. 16A-16L, or a corresponding HCV NS4B amino acid sequence of any HCV genotype; and the NS4B T-cell epitope can have a length of from 8 amino acids (aa) to 15 amino acids (e.g., 8 aa, 9 aa, 10 aa, 11 aa, 12 aa, 13 aa, 14 aa, or 15 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1921-1935 of the amino acid sequence designated "Consensus" in FIGS. 16A-16L, or a corresponding HCV NS4B amino acid sequence of any HCV genotype; and the NS4B T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1922-1941 of the amino acid sequence designated "Consensus" in FIGS. 16A-16L, or a corresponding HCV NS4B amino acid sequence of any HCV genotype; and the NS4B T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1928-1947 of the amino acid sequence designated "Consensus" in FIGS. 16A-16L, or a corresponding HCV NS4B amino acid sequence of any HCV genotype; and the NS4B T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1868-1876 of the amino acid sequence designated "Consensus" in FIGS. 16A-16L, or a corresponding HCV NS4B amino acid sequence of any HCV genotype; and the NS4B T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1927-1942 of the amino acid sequence designated "Consensus" in FIGS. 16A-16L, or a corresponding HCV NS4B amino acid sequence of any HCV genotype; and the NS4B T-cell epitope can have a length of from 16 amino acids (aa) to 20 amino acids (e.g., 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1932-1940 of the amino acid sequence designated "Consensus" in FIGS. 16A-16L, or a corresponding HCV NS4B amino acid sequence of any HCV genotype; and the NS4B T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1948-1962 of the amino acid sequence designated "Consensus" in FIGS. 16A-16L, or a corresponding HCV NS4B amino acid sequence of any HCV genotype; and the NS4B T-cell epitope can have a length of from 15 amino acids (aa) to 20 amino acids (e.g., 15 aa, 16 aa, 17 aa, 18 aa, 19 aa, or 20 aa).

HCV NS5A T-Cell Epitopes

In some cases, the heterologous polypeptide present in an E2 variant polypeptide of an E1/E2 heterodimer of the present disclosure includes one or more T-cell epitopes present in an HCV NS5A polypeptide. Examples of T-cell epitopes present in NS5A polypeptides are depicted in FIGS. 15A-15N and FIG. 13B.

As one example, the heterologous polypeptide can comprise an NS5A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2218-2232 of the amino acid sequence designated "Consensus" in FIGS. 16A-16L, or a corresponding HCV NS5A amino acid sequence of any HCV genotype; and the NS5A T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an NS5A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2309-2317 of the amino acid sequence designated "Consensus" in FIGS. 16A-16L, or a corresponding HCV NS5A amino acid sequence of any HCV genotype; and the NS5A T-cell epitope can have a length of from 9 amino acids (aa) to 15 amino acids (e.g., 9 aa, 10 aa, 11 aa, 12 aa, 13 aa, 14 aa, or 15 aa).

HCV NS5B T-Cell Epitopes

In some cases, the heterologous polypeptide present in an E2 variant polypeptide of an E1/E2 heterodimer of the present disclosure includes one or more T-cell epitopes present in an HCV NS5B polypeptide. Examples of T-cell epitopes present in NS5B polypeptides are depicted in FIGS. 15A-15N and FIG. 13B.

As one example, the heterologous polypeptide can comprise an NS5B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2847-2851 of the amino acid sequence designated "Consensus" in FIGS. 16A-16L, or a corresponding HCV NS5B amino acid sequence of any HCV genotype; and the NS5B T-cell epitope can have a length of from 5 amino acids (aa) to 10 amino acids (e.g., 5 aa, 6 aa, 7 aa, 8 aa, 9 aa, or 10 aa).

As another example, the heterologous polypeptide can comprise an NS5B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2602-2610 of the amino acid sequence designated "Consensus" in FIGS. 16A-16L, or a corresponding HCV NS5B amino acid sequence of any HCV genotype; and the NS5B T-cell epitope can have a length of from 9 amino acids (aa) to 15 amino acids (e.g., 9 aa, 10 aa, 11 aa, 12 aa, 13 aa, 14 aa, or 15 aa).

HCV Core T-Cell Epitopes

In some cases, the heterologous polypeptide present in an E2 variant polypeptide of an E1/E2 heterodimer of the present disclosure includes one or more T-cell epitopes present in an HCV core polypeptide. Examples of T-cell epitopes present in HCV Core polypeptides are depicted in FIGS. 15A-15N and FIG. 13A.

As one example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1-20 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 11-30 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 21-40 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 39-63 of the amino acid sequence designated "Consensus" in FIGS. 16A-16L, or a corresponding HCV core amino acid sequence of any HCV genotype; and the HCV core T-cell epitope can have a length of from 23 amino acids (aa) to 28 amino acids (e.g., 23 aa, 24 aa, 25 aa, 26 aa, 27 aa, or 28 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 47-70 of the amino acid sequence designated "Consensus" in FIGS. 16A-16L, or a corresponding HCV core amino acid sequence of any HCV genotype; and the HCV core T-cell epitope can have a length of from 24 amino acids (aa) to 29 amino acids (e.g., 24 aa, 25 aa, 26 aa, 27 aa, 28 aa, or 29 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 61-80 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 71-90 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 81-100 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 91-110 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 101-115 of the amino acid sequence designated "Consensus" in FIGS. 16A-16L, or a corresponding HCV core amino acid sequence of any HCV genotype; and the HCV core T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 111-130 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 125-139 of the amino acid sequence designated "Consensus" in FIGS. 16A-16L, or a corresponding HCV core amino acid sequence of any HCV genotype; and the HCV core T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 131-150 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 151-170 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 161-180 of the amino acid sequence designated "Consensus" in FIGS. 16A-16L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 35-44 of the amino acid sequence designated "Consensus" in FIGS. 16A-16L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 43-51 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 51-59 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 129-137 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 131-140 of the amino acid sequence designated "Consensus" in FIGS. 16A-16L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 150-158 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 154-162 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 168-176 of the amino acid sequence designated "Consensus" in FIGS. 16A-16L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 177-187 of the amino acid sequence designated "Consensus" in FIGS. 16A-16L, or a corresponding HCV core amino acid sequence of any HCV genotype; and the HCV core T-cell epitope can have a length of from 11 amino acids (aa) to 16 amino acids (e.g., 11 aa, 12 aa, 13 aa, 14 aa, 15 aa, or 16 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 178-187 of the amino acid sequence designated "Consensus" in FIGS. 16A-16L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 191 aa (e.g., from 10 aa to 25 aa, from 25 aa to 50 aa, from 50 aa to 75 aa, from 75 aa to 100 aa, from 100 aa to 150 aa, or from 150 aa to 191 aa) of amino acids 1-191 of the amino acid sequence designated "Consensus" in FIGS. 16A-16L, or a corresponding HCV core amino acid sequence of any HCV genotype; and has a length of from 10 amino acids (aa) to 25 aa, from 25 aa to 50 aa, from 50 aa to 100 aa, or from 100 aa to 150 aa, or from 150 aa to 191 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1-191 of the amino acid sequence designated "Consensus" in FIGS. 16A-16L, or a corresponding HCV core amino acid sequence of any HCV genotype; and has a length of about 191 amino acids.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQIVG-GVYLLPRRGPRLGVRATRKTS ERSQPRGRRQPIP-KARRPEGRTWAQPGYPWPLYGNEGCGWAGWLL-SPRGSRPS WGPTDPRRRSRNLGKVIDTLTCGFADLMGYIPLVGA-PLGGAARALAHGVRVLE DGVNYATGNLPG (SEQ ID NO:63); and has a length of from 171 amino acids (aa) to 180 aa (e.g., 171 aa, 172 aa, 173 aa, 174 aa, 175 aa, 176 aa, 177 aa, 178 aa, 179 aa, or 180 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPK-PQRKTKRNTNRRPQDVKFPGGGQIVGGVYLLPRRG-PRLGVRATRKTS ERSQPRGRRQPIPKARRPEGRT-WAQPGYPWPLYGNEGCGWAGWLLSPRGSRPS WGPTDPRRRSRNLGKVIDTLTCGFADLMGYIPLVGA-PLGGAARALAHGVRVLE DGVNYATGNLPG (SEQ ID NO:63); and has a length of 171 amino acids. Such a polytope can include core T-cell epitopes designated Core-1, Core-2, Core-3, Core-4, Core-5, Core-6, Core-7, Core-8, Core-9, Core-10, Core-11, Core-12, Core-13, Core-14, Core-16, Core-17, Core-18, Core-19, Core-20, Core-21, Core-22 in FIG. 13A and FIGS. 15A-15N.

HCV p7 T-Cell Epitopes

In some cases, the heterologous polypeptide present in an E2 variant polypeptide of an E1/E2 heterodimer of the present disclosure includes one or more T-cell epitopes present in an HCV p7 polypeptide. Examples of T-cell epitopes present in HCV p7 polypeptides are depicted in FIGS. 15A-15N or FIG. 13A.

As another example, the heterologous polypeptide can comprise an HCV p7 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 803-811 of the amino acid sequence designated "Consensus" in FIGS. 16A-16L, or a corresponding HCV p7 amino acid sequence of any HCV genotype; and the HCV p7 T-cell epitope can have a length of from 9 amino acids (aa) to 15 amino acids (e.g., 9 aa, 10 aa, 11 aa, 12 aa, 13 aa, 14 aa, or 15 aa).

Polytopes Including HCV T-Cell Epitopes from more than One HCV Polypeptide other than E1 and E2

As noted above, a heterologous polypeptide can include T-cell epitopes from more than one HCV polypeptide other than E1 and E2.

As one example, a heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: QASLLKVPYFVRVQGLLRICALARKMAG-GHYVQMAIIKLGALTGTYVYNALTP LRDWAHNGL-RDLAVAVEPVVFSQMETKLITWGADTAACGDI-INGLPVSARRGR EILLGPADGMVSKGWRLLAPITAYAQQTRGLLGCIIT-SLTGRDKNQVEGEVQIVS TAAQTFLATCINGVCWT-VYHGAGTRTIASPKGPVIQMYTNVDQDLVGW-PAPQG ARSLTPCTCGSSDLYLVTRHADVIPVRRRGDSRGSLL-SPRPISYLKGSAGGPLLCP AGHAVGIFRAAVCTRG- VAKAVDFIPVENLETTMRSPVFTDNSSPPAVPQSFQVA HLHAPTGSGKSTKVPAAYAAQGYKVLVLNPSVAATL-GFGAYMSKAHGIDPNIR TGVRTITTGSPITYSTYGK-FLADGGCSGGAYDIIICDECHSTDATSILGIGTVLDQA ETAGARLVVLATATPPGSVTVPHPNIEEVALSTTGEIP-FYGKAIPLEVIKGGRHLIF CHSKKKCDELAAKLVAL-GINAVAYYRGLDVSVIPTSGDVVVVATDALMTGFTG DFDSVIDCN (SEQ ID NO:12); and has a length of from 550 amino acids (aa) to 560 aa (e.g., 550 aa, 551 aa, 552 aa, 553 aa, 554 aa, 555 aa, 556 aa, 557 aa, 558 aa, 559 aa, or 560 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: QASLLKVPYFVRVQGLLRICALARKMAG-GHYVQMAIIKLGALTGTYVYNALTP LRDWAHNGL-RDLAVAVEPVVFSQMETKLITWGADTAACGDI-INGLPVSARRGR EILLGPADGMVSKGWRLLAPITAYAQQTRGLLGCIIT-SLTGRDKNQVEGEVQIVS TAAQTFLATCINGVCWT-VYHGAGTRTIASPKGPVIQMYTNVDQDLVGW-PAPQG ARSLTPCTCGSSDLYLVTRHADVIPVRRRGDSRGSLL-SPRPISYLKGSAGGPLLCP AGHAVGIFRAAVCTRG-VAKAVDFIPVENLETTMRSPVFTDNSSPPAVPQSFQVA HLHAPTGSGKSTKVPAAYAAQGYKVLVLNPSVAATL-GFGAYMSKAHGIDPNIR TGVRTITTGSPITYSTYGK-FLADGGCSGGAYDIIICDECHSTDATSILGIGTVLDQA ETAGARLVVLATATPPGSVTVPHPNIEEVALSTTGEIP-FYGKAIPLEVIKGGRHLIF CHSKKKCDELAAKLVAL-GINAVAYYRGLDVSVIPTSGDVVVVATDALMTGFTG DFDSVIDCN (SEQ ID NO: 12); and has a length of 553 amino acids. Such a polytope can include T-cell epitopes designated NS2-1, NS2-2, NS2-3, NS2-4, NS2-5, NS2-6, NS2-7, NS2-8, NS3-1, NS3-2, NS3-3, NS3-4, NS3-5, NS3-6, NS3-7, NS3-9, NS3-10, NS3-11, NS3-12, and NS3-13 in FIGS. 13A-13B and FIGS. 15A-15N. This polytope is also referred to as "TP553" (FIGS. 14A-14D). In order to prevent self cleavage of the TP553 polytope (amino acids 917-1469) (FIGS. 15E-G) at the NS2-NS3 junction that is mediated by the catalytic domain of the NS2 protease (amino acids 917-1040), the histidine at position 966 (H966), a critical residue for NS2 protease activity, is mutated to alanine (H966A) (FIG. 15E).

As another example, the heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 778 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 450 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 778 aa) the following amino acid sequence: LHAPTGSGKSTKVPAAYAAQGYKVLVLNPSVAATLG-FGAYMSKAHGIDPNIRTGVRTIT TGSPITYSTYGK-FLADGGCSGGAYDIIICDECHSTDATSILGIGTV-LDQAETAGARLVVLA TATPPGSVTVPHPNIEEVALSTTGEIPFYGKAIPLEVIK-GGRHLIFCHSKKKCDELAAKLV ALGINAVAYYRGLD-VSVIPTSGDVVVVATDALMTGFTGDFDSVID-CNTCVTQTVDFSLD PTFTIETTTLPQDAVSRTQRRGRTGRGKPGIYR-FVAPGERPSGMFDSSVLCECYDAGCA WYELTPAETT-VRLRAYMNTPGLPVCQDHLEFWEGVFTGLTHIDAH-FLSQTKQSGENLP YLVAYQATVCARAQAPPPSWDQMWKCLIRLKPTLH-GPTPLLYRLGAVQNEVTLTHPIT KYIMTCMSADLEV-VTSTWVLVGGVLAALAAYCLSTGCVVIVGRIVLS-GKPAIIPDREVL YREFDEMEECSQHLPYIEQGMMLAEQFKQKAL-GLLQTASRQAEVIAPAVQTNWQKLEA FWAKHMWN-FISGIQYLAGLSTLPGNPAIASLMA-FTAAVTSPLTTSQTLLFNILGGWVAA QLAAPGAATAFVGAGLAGAAIGSVGLGKVLVDI-LAGYGAGVAGALVAFKIMSGEVPST EDLVNLLPAIL-SPGALVVGVVCAAILRRHVGPGEGAVQWMNRLIA-FASRGNHVSPTHY VPESDAAARVTAILSSLTVTQLLRRLHQWIS-SECTTPCSGSWLRDIWDWICEVLSDFKTW LKAK-LMPQLPG (SEQ ID NO:64). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 778 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 450 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 778 aa) of the following amino acid sequence: LHAPTGSGKSTKVPAAYAAQ-GYKVLVLNPSVAATLGFGAYMSKAHGIDPNIRTGVR-TIT TGSPITYSTYGKFLADGGCSGGAYDIIICDECHST-DATSILGIGTVLDQAETAGARLVVLA TATPPGSVTVPHPNIEEVALSTTGEIPFYGKAIPLEVIK-GGRHLIFCHSKKKCDELAAKLV ALGINAVAYYRGLD-VSVIPTSGDVVVVATDALMTGFTGDFDSVID-CNTCVTQTVDFSLD PTFTIETTTLPQDAVSRTQRRGRTGRGKPGIYR-FVAPGERPSGMFDSSVLCECYDAGCA WYELTPAETT-VRLRAYMNTPGLPVCQDHLEFWEGVFTGLTHIDAH-FLSQTKQSGENLP YLVAYQATVCARAQAPPPSWDQMWKCLIRLKPTLH-GPTPLLYRLGAVQNEVTLTHPIT KYIMTCMSADLEV-VTSTWVLVGGVLAALAAYCLSTGCVVIVGRIVLS-GKPAIIPDREVL YREFDEMEECSQHLPYIEQGMMLAEQFKQKAL-GLLQTASRQAEVIAPAVQTNWQKLEA FWAKHMWN-FISGIQYLAGLSTLPGNPAIASLMA-FTAAVTSPLTTSQTLLFNILGGWVAA QLAAPGAATAFVGAGLAGAAIGSVGLGKVLVDI-LAGYGAGVAGALVAFKIMSGEVPST EDLVNLLPAIL-SPGALVVGVVCAAILRRHVGPGEGAVQWMNRLIA-FASRGNHVSPTHY VPESDAAARVTAILSSLTVTQLLRRLHQWIS-SECTTPCSGSWLRDIWDWICEVLSDFKTW LKAK-LMPQLPG (SEQ ID NO:64); and has a length of from 25 amino acids (aa) to 50 aa, from 50 aa to 100 aa, from 100 aa to 200 aa, from 200 aa to 300 aa, from 300 aa to 400 aa, from 400 aa to 500 aa, from 500 aa to 600 aa, from 600 aa to 700 aa, or from 700 aa to 778 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGS-GKSTKVPAAYAAQGYKVLVLNPSVAATLGFGAYM-SKAHGIDPNIRTGVRTIT TGSPITYSTYGKFLADGGC-SGGAYDIIICDECHSTDATSILGIGTVLDQAETAGA-RLVVLA TATPPGSVTVPHPNIEEVALSTTGEIPFYGKAIPLEVIK-GGRHLIFCHSKKKCDELAAKLV ALGINAVAYYRGLD-VSVIPTSGDVVVVATDALMTGFTGDFDSVID-CNTCVTQTVDFSLD PTFTIETTTLPQDAVSRTQRRGRTGRGKPGIYR-FVAPGERPSGMFDSSVLCECYDAGCA WYELTPAETT-VRLRAYMNTPGLPVCQDHLEFWEGVFTGLTHIDAH-FLSQTKQSGENLP YLVAYQATVCARAQAPPPSWDQMWKCLIRLKPTLH-GPTPLLYRLGAVQNEVTLTHPIT KYIMTCMSADLEV-VTSTWVLVGGVLAALAAYCLSTGCVVIVGRIVLS-GKPAIIPDREVL YREFDEMEECSQHLPYIEQGMMLAEQFKQKAL-GLLQTASRQAEVIAPAVQTNWQKLEA FWAKHMWN-FISGIQYLAGLSTLPGNPAIASLMA-FTAAVTSPLTTSQTLLFNILGGWVAA QLAAPGAATAFVGAGLAGAAIGSVGLGKVLVDI-LAGYGAGVAGALVAFKIMSGEVPST EDLVNLLPAIL-SPGALVVGVVCAAILRRHVGPGEGAVQWMNRLIA-FASRGNHVSPTHY VPESDAAARVTAILSSLTVTQLLRRLHQWIS-SECTTPCSGSWLRDIWDWICEVLSDFKTW LKAK-LMPQLPG (SEQ ID NO:64); and has a length of 778 amino acids. Such a polytope can include T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS2-14, NS4a-1, NS4b-1, NS4b-2, NS4b-3, NS4b-4, NS4b-5, NS4b-6, NS4b-7, NS4b-8, NS4b-9, and NS4b-10 in FIG. 13B and FIGS. 15A-15N.

As another example, the heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 1985 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 500 aa, from 500 aa to 750 aa, from 750 aa to 1000 aa, from 1000 aa to 1500 aa, or from 1500 aa to 1985 aa) of the following amino acid sequence:

(SEQ ID NO: 13)
APITAYAQQTRGLLGCIITSLTGRDKNQVEGEVQIVSTAAQTFLATCING

VCWTVYHGAGTRTIASPKGPVIQMYTNVDQDLVGWPAPQGARSLTPCTCG

SSDLYLVTRHADVIPVRRRGDSRGSLLSPRPISYLKGSAGGPLLCPAGHA

VGIFRAAVCTRGVAKAVDFIPVENLETTMRSPVFTDNSSPPAVPQSFQVA

-continued

HLHAPTGSGKSTKVPAAYAAQGYKVLVLNPSVAATLGFGAYMSKAHGIDP

NIRTGVRTITTGSPITYSTYGKFLADGGCSGGAYDIIICDECHSTDATSI

LGIGTVLDQAETAGARLVVLATATPPGSVTVPHPNIEEVALSTTGEIPFY

GKAIPLEVIKGGRHLIFCHSKKKCDELAAKLVALGINAVAYYRGLDVSVI

PTSGDVVVVATDALMTGFTGDFDSVIDCNTCVTQTVDFSLDPTFTIETTT

LPQDAVSRTQRRGRTGRGKPGIYRFVAPGERPSGMFDSSVLCECYDAGCA

WYELTPAETTVRLRAYMNTPGLPVCQDHLEFWEGVFTGLTHIDAHFLSQT

KQSGENLPYLVAYQATVCARAQAPPPSWDQMWKCLIRLKPTLHGPTPLLY

RLGAVQNEVTLTHPITKYIMTCMSADLEVVTSTWVLVGGVLAALAAYCLS

TGCVVIVGRIVLSGKPAIIPDREVLYREFDEMEECSQHLPYIEQGMMLAE

QFKQKALGLLQTASRQAEVIAPAVQTNWQKLEAFWAKHMWNFISGIQYLA

GLSTLPGNPAIASLMAFTAAVTSPLTTSQTLLFNILGGWVAAQLAAPGAA

TAFVGAGLAGAAIGSVGLGKVLVDILAGYGAGVAGALVAFKIMSGEVPST

EDLVNLLPAILSPGALVVGVVCAAILRRHVGPGEGAVQWMNRLIAFASRG

NHVSPTHYVPESDAAARVTAILSSLTVTQLLRRLHQWISSECTTPCSGSW

LRDIWDWICEVLSDFKTWLKAKLMPQLPGIPFVSCQRGYRGVWRGDGIMH

TRCHCGAEITGHVKNGTMRIVGPRTCRNMWSGTFPINAYTTGPCTPLPAP

NYTFALWRVSAEEYVEIRQVGDFHYVTGMTTDNLKCPCQVPSPEFFTELD

GVRLHRFAPPCKPLLREEVSFRVGLHEYPVGSQLPCEPEPDVAVLTSMLT

DPSHITAEAAGRRLARGSPPSVASSSASQLSAPSLKATCTANHDSPDAEL

IEANLLWRQEMGGNITRVESENKVVILDSFDPLVAEEDEREISVPAEILR

KSRRFAPALPIWARPDYNPPLLETWKKPDYEPPVVHGCPLPPPQSPPVPP

PRKKRTVVLTESTVSTALAELATKSFGSSSTSGITGDNTTTSSEPAPSGC

PPDSDAESYSSMPPLEGEPGDPDLSDGSWSTVSSEADTEDVVCCSMSYSW

TGALVTPCAAEEQKLPINALSNSLLRHHNLVYSTTSRSACQRQKKVTFDR

LQVLDSHYQDVLKEVKAAASKVKANLLSVEEACSLTPPHSAKSKFGYGAK

DVRCHARKAVNHINSVWKDLLEDSVTPIDTTIMAKNEVFCVQPEKGGRKP

ARLIVFPDLGVRVCEKMALYDVVSKLPLAVMGSSYGFQYSPGQRVEFLVQ

AWKSKKTPMGFSYDTRCFDSTVTESDIRTEEAIYQCCDLDPQARVAIKSL

TERLYVGGPLTNSRGENCGYRRCRASGVLTTSCGNTLTCYIKARAACRAA

GLQDCTMLVCGNNLVVICESAGVQEDAASLRAFTEAMTRYSAPPGDPPQP

EYDLELITSCSSNVSVAHDGAGKRVYYLTRDPTTPLARAAWETARHTPVN

SWLGNIIMFAPTLWARMILMTHFFSVLIARDQLEQALDCEIYGACYSIEP

LDLPPIIQRLHGLSAFSLHSYSPGEINRVAACLRKLGVPPLRAWRHRARS

VRARLLSRGGRAAICGKYLFNWAVRTKLKLTPIAAAGQLDLSGWFTAGYS

GGDIYHSVSHARPRWFWFCLLLLAAGVGIYLLPNR.

In some cases, the heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: APITAYAQQTRGLLGCIITSLTGRDKNQVEG-EVQIVSTAAQTFLATCINGVCWTV YHGAGTRTIASP-KGPVIQMYTNVDQDLVGWPAPQGARSLTPCTCGSS-DLYLVT RHADVIPVRRRGDSRGSLLSPRPISYLKGS AGGPLLCPAGHAVGIFRAAVCTRGV AKAVDFIPVEN-LETTMRSPVFTDNSSPPAVPQSFQVAHLHAPTGSGK-STKVPAA YAAQGYKVLVLNPSVAATLGFGAYM-SKAHGIDPNIRTGVRTITTGSPITYSTYG KFLADGGCSGGAYDIIICDECHSTDATSILGIGTV-LDQAETAGARLVVLATATPP GSVTVPHPNIEEVALST-TGEIPFYGKAIPLEVIKGGRHLIFCHSKKKCDE-LAAKLV ALGINAVAYYRGLDVSVIPTSGDVVVVATDALMTG-FTGDFDSVIDCNTCVTQT VDFSLDPTFTIETTTLPQ-DAVSRTQRRGRTGRGKPGIYRFVAPGERPSGMFDSSV LCECYDAGCAWYELTPAETTVRLRAYMNTPGLPVC-QDHLEFWEGVFTGLTHID AHFLSQTKQSGENLPYL-VAYQATVCARAQAPPPSWDQMWKCLIRLKPTLHGPT PLLYRLGAVQNEVTLTHPITKYIMTCMSADLEV-VTSTWVLVGGVLAALAAYCL STGCVVIVGRIVLS-GKPAIIPDREVLYREFDEMEECSQHLPYIEQGMM-LAEQFKQ KALGLLQTASRQAEVIAPAVQTNWQKLEAFWAKHM-WNFISGIQYLAGLSTLPG NPAIASLMA-FTAAVTSPLTTSQTLLFNILGGWVAAQLAAP-GAATAFVGAGLAGA AIGSVGLGKVLVDILAGYGAGVAGALVAFKIMS-GEVPSTEDLVNLLPAILSPGAL VVGVVCAAILR-RHVGPGEGAVQWMNRLIAFASRGNHVSPTHYVPES-DAAARV TAILSSLTVTQLLRRLHQWISSECTTPCSGSWLRDI-WDWICEVLSDFKTWLKAKL MPQLPGIPFVSCQR-GYRGVWRGDGIMHTRCHCGAEITGHVKNGTM-RIVGPRTC RNMWSGTFPINAYTTGPCTPLPAPNYTFALWRV-SAEEYVEIRQVGDFHYVTGM TTDNLKCPCQVPSP-EFFTELDGVRLHRFAPPCKPLLREEVSFRVGL-HEYPVGSQL PCEPEPDVAVLTSMLTDPSHITAEAAGRRLARGSPPS-VASSSASQLSAPSLKATCT ANHDSPDAELIEANLL-WRQEMGGNITRVESENKVVILDSFDPLVAEEDER-EISVP AEILRKSRRFAPALPIWARPDYNPPLLETWKKPDYEP-PVVHGCPLPPPQSPPVPPP RKKRTVVLTESTVSTA-LAELATKSFGSSSTSGITGDNTTTSSEPAPSGCPPDS-DAE SYSSMPPLEGEPGDPDLSDGSWSTVSSEADTEDV-VCCSMSYSWTGALVTPCAAE EQKLPINALSNSLL-RHHNLVYSTTSRSACQRQKKVTFDRLQVLDSHYQD-VLKEV KAAASKVKANLLSVEEACSLTPPHSAKSKFGY-GAKDVRCHARKAVNHINSVW KDLLEDSVTPIDTTI-MAKNEVFCVQPEKGGRKPARLIVFPDLGVRVCEK-MALYD VVSKLPLAVMGSSYGFQYSPGQRVEFLVQAWKSKK-TPMGFSYDTRCFDSTVTE SDIRTEEAIYQCCDLD-PQARVAIKSLTERLYVGGPLTNSRGENCGYRRCRAS-GVL TTSCGNTLTCYIKARAACRAAGLQDCTMLVCG NNLVVICESAGVQEDAASLRA FTEAMTRYSAPPGDP-PQPEYDLELITSCSSNVSVAHDGAGKRVYYLTRDPTT-PLA RAAWETARHTPVNSWLGNIIMFAPTLWARM-ILMTHFFSVLIARDQLEQALDCEI YGACYSIEPLDLPPIIQRLHGLSAFSLHSYSPGEIN-RVAACLRKLGVPPLRAWRHR ARSVRARLLSRG-GRAAICGKYLFNWAVRTKLKLTPIAAAGQLDLSGW-FTAGYS GGDIYHSVSHARPRWFWFCLLLLAAGVGIYLLPNR (SEQ ID NO:13); and has a length of 1985 amino acids. Such a polytope can include T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10, NS5a-1, NS5a-2, NS5b-1, NS5b-2 in FIGS. 13A-13B and FIGS. 15A-15N.

Additional T-Cell Epitopes

As discussed above, the one or more T-cell epitopes present in a heterologous polypeptide can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide comprises one or more T cell epitopes present in: a) cholera toxin; and/or b) tetanus toxin; and/or c) diphtheria toxin; and/or d) a meningococcal outer membrane protein.

Thus, in some cases, a variant HCV polypeptide of includes: a) an HCV E1 polypeptide; and b) a heterologous polypeptide that comprises one or more T-cell epitopes, where the one or more T-cell epitopes are T-cell epitopes present in: i) one or more of an HCV NS3 polypeptide, an HCV NS2 polypeptide, an HCV NS4A polypeptide, an HCV NS4B polypeptide, an HCV NS5A polypeptide, an HCV NS5B polypeptide, an HCV core polypeptide, and an HCV p7 polypeptide; and ii) one or more of cholera toxin or toxoid, tetanus toxin or toxoid, diphtheria toxin or toxoid, and a meningococcal outer membrane protein.

A T helper tetanus toxin epitope or other bacterial T-cell epitope could be fused (e.g., by recombinant expression) or chemically conjugated to the HCV polytope/E2 fusion protein and/or to the HCV polytope E1 fusion protein of an E1/E2 heterodimer of the present disclosure to further enhance both T and B cell responses to both the HCV polytope and E1/E2 moieties. Alternatively, the whole or part of the detoxified toxin ("toxoid") could be fused (e.g., by recombinant expression) or chemically conjugated to the HCV polytope/E1E2 protein, wherein specific amino acids of the toxins are mutated to render the toxins inactive, thereby generating toxoids. Methods of generating toxoids are well known in the art. Examples of bacterial epitopes include the use of diphtheria toxoid, meningococcal outer membrane protein, or mutant diphtheria protein CRM197 (see, e.g.: www(dot)medscape(dot)com/viewarticle/431127)

In some cases, a suitable tetanus toxoid polypeptide comprises the amino acid sequence QYIKANSKFIGIFE (SEQ ID NO: 14). In some cases, a suitable tetanus toxoid polypeptide comprises the amino acid sequence QYIKAN-SKFIGITE (SEQ ID NO:65).

In some cases, a heterologous polypeptide can comprise cholera toxin (or toxoid) epitope. In some cases, a suitable heterologous polypeptide comprising a cholera toxoid epitope comprises a fragment of cholera toxin-B subunit (CT-B), e.g., a fragment of from 5 amino acids to 25 amino acids, or from 25 amino acids to 50 amino acids, of the following amino acid sequence: MIKLKFGVFF TVLLSSAYAH GTPQNITDLC AEYHNTQIHT LNDKIF-SYTE SLAGKREMAI ITFKNGATFQ VEVPGSQHID SQKKAIERMK DTLRIAYLTE AKVEKLCVWN NKT-PHAIAAI SMAN (SEQ ID NO:15). In some cases, a suitable heterologous polypeptide comprising a cholera toxoid epitope comprises the following amino acid sequence: SLAGKREMAIITFKNGATFQVEVPG (SEQ ID NO:29).

In some cases, a heterologous polypeptide can comprise a tetanus toxin (or toxoid) T-cell epitope. In some cases, a suitable heterologous polypeptide comprising a tetanus toxin T-cell epitope comprises the amino acid sequence: ILMQYIKANSKFIGI (SEQ ID NO:16); and has a length of from 15 amino acids to 20 amino acids. In some cases, a suitable heterologous polypeptide comprising a tetanus toxin T-cell epitope comprises the amino acid sequence: VNNESSE (SEQ ID NO: 17). In some cases, a suitable heterologous polypeptide comprising a tetanus toxin T-cell epitope comprises the amino acid sequence: PGINGKAIHLVNNESSE (SEQ ID NO: 18). In some cases, a suitable heterologous polypeptide comprising a tetanus toxin T-cell epitope comprises the amino acid sequence: PNRDIL (SEQ ID NO: 19). In some cases, a suitable heterologous polypeptide comprising a tetanus toxin T-cell epitope comprises the amino acid sequence: FIGITEL (SEQ ID NO:20). In some cases, a suitable tetanus toxin T-cell epitope comprises the amino acid sequence: SYFPSV (SEQ ID NO:21). In some cases, a suitable heterologous polypeptide comprising a tetanus toxin T-cell epitope comprises the amino acid sequence: NSVDDALINSTKIYSYFPSV (SEQ ID NO:22). In some cases, a suitable heterologous polypeptide comprising a tetanus toxin T-cell epitope comprises the amino acid sequence: IDKISDVSTIVPYIGPALNI (SEQ ID NO:23).

In some cases, a heterologous polypeptide can comprise a diphtheria toxin T-cell epitope In some cases, a suitable heterologous polypeptide comprising a diphtheria toxin T-cell epitope comprises the amino acid sequence: QSIALSSLMVAQAIP (SEQ ID NO:24); and has a length of from 15 amino acids to 20 amino acids. In some cases, a suitable heterologous polypeptide comprising a diphtheria toxin T-cell epitope comprises the amino acid sequence: PVFAGANYAAWAVNVAQVI (SEQ ID NO:25). In some cases, a suitable heterologous polypeptide comprising a diphtheria toxin T-cell epitope comprises the amino acid sequence: VHHNTEEIVAQSIALSSLMV (SEQ ID NO:26). In some cases, a suitable heterologous polypeptide comprising a diphtheria toxin T-cell epitope comprises the amino acid sequence: QSIALSSLMVAQAIPLVGEL (SEQ ID NO:66). In some cases, a suitable heterologous polypeptide comprising a diphtheria toxin T-cell epitope comprises the amino acid sequence: VDIGFAAYNFVESIINLFQV (SEQ ID NO:67). In some cases, a suitable heterologous polypeptide comprising a diphtheria toxin T-cell epitope comprises the amino acid sequence: QGESGHDIKITAENTPLPIA (SEQ ID NO:68). In some cases, a suitable heterologous polypeptide comprising a diphtheria toxin T-cell epitope comprises the amino acid sequence: GVLLPTIPGKLDVNKSKTHI (SEQ ID NO:69). In some cases, a suitable heterologous polypeptide comprising a diphtheria toxin T-cell epitope comprises the amino acid sequence of CRM197 (see, e.g., Giannini et al. (1984) Nucl. Acids. Res. 12:4063). The amino acid sequence of CRM197 is provided above.

In some cases, a heterologous polypeptide can comprise a tetanus toxin T-cell epitope and a diphtheria toxin T-cell epitope. In some of these cases, the heterologous polypeptide can comprise the amino acid sequence: IMQYIKANSKFIGIQSIALSSLMVAQ (SEQ ID NO:28); and can have a length of from 26 amino acids to 30 amino acids.

Additional Polypeptides

In any of the above-described embodiments, the variant E1 polypeptide can include one or more additional polypeptides. For example, in some cases, the variant E1 polypeptide includes an Ig Fc polypeptide at the C-terminus of variant E1 polypeptide. As another example, the variant E1 polypeptide includes an Ig Fc polypeptide at the N-terminus of variant E1 polypeptide. Ig Fc polypeptides are known in the art, and are described elsewhere herein.

IV. Nucleic Acids Encoding a Variant HCV E1 Polypeptide, a Variant HCV E2 Polypeptide, or an E1/E2 Heterodimer The present disclosure provides a nucleic acid comprising a nucleotide sequence encoding a variant HCV E2 polypeptide of the present disclosure. The present disclosure provides a nucleic acid comprising a nucleotide sequence encoding a variant HCV E1 polypeptide of the present disclosure. The present disclosure provides a nucleic acid comprising a nucleotide sequence an E1/E2 heterodimer of the present disclosure.

As described below, a variant HCV E1 polypeptide, a variant HCV E2 polypeptide, or a heterodimer comprising: i) a variant HCV E2 polypeptide and an HCV E1 polypeptide; ii) a variant HCV E1 polypeptide and an HCV E2 polypeptide; or iii) a variant HCV E1 polypeptide and a variant HCV E2 polypeptide, can be encoded by a nucleotide sequence of a nucleic acid of the present disclosure. Where an Ig Fc region is at the C-terminus of the encoded heterodimer, a proteolytically cleavable linker can be positioned between the Fc region and the polypeptide at the N-terminus of the Ig Fc region.

IV(A). Variant E2 and E1/E2 Heterodimers Comprising a Variant E2 Polypeptide

The present disclosure provides a nucleic acid comprising a nucleotide sequence encoding a variant HCV E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). The present disclosure provides a nucleic acid comprising a nucleotide sequence encoding a polyprotein comprising a variant E2 polypeptide of the present disclosure. In some cases, the nucleic acid is present in an expression vector. Thus, the present disclosure provides a recombinant expression vector comprising a nucleotide sequence encoding a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide).

In some cases, a nucleic acid of the present disclosure comprises a nucleotide sequence encoding a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the nucleotide sequence encoding the variant E2 polypeptide is operably linked to a transcription control element, e.g., a promoter that is functional in a eukaryotic cell. Suitable promoters include, e.g., a cytomegalovirus (CMV) promoter, an SV40 promoter, and the like. In some cases, the nucleic acid is present in an expression vector (e.g., a lentivirus vector; an adenoassociated virus vector; an adenovirus vector; a retroviral vector; a non-viral vector; etc.). In some cases, the nucleic acid is present in an expression vector, where the expression vector is a non-viral vector.

In some cases, a nucleic acid of the present disclosure comprises a nucleotide sequence encoding a fusion protein comprising, in order from N-terminus to C-terminus: a) an immunoglobulin (Ig) Fc region; and b) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In some cases, the variant HCV E2 polypeptide comprises, in order from N-terminus to C-terminus: i) the heterologous polypeptide comprising the one or more T cell epitopes; and ii) the HCV E2 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adenoassociated virus vector; an adenovirus vector; a retroviral vector; a non-viral vector; etc.). In some cases, a nucleic acid of the present disclosure comprises a nucleotide sequence encoding a fusion protein comprising, in order from N-terminus to C-terminus: a) an Ig Fc region; b) a proteolytically cleavable linker; and c) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In other cases, the variant HCV E2 polypeptide comprises, in order from N-terminus to C-terminus: i) the heterologous polypeptide comprising the one or more T cell epitopes; and ii) the HCV E2 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adenoassociated virus vector; an adenovirus vector; a retroviral vector; a non-viral vector; etc.).

The proteolytically cleavable linker can include a protease recognition sequence recognized by a protease selected from the group consisting of alanine carboxypeptidase, *Armillaria mellea* astacin, bacterial leucyl aminopeptidase, cancer procoagulant, cathepsin B, clostripain, cytosol alanyl aminopeptidase, elastase, endoproteinase Arg-C, enterokinase, gastricsin, gelatinase, Gly-X carboxypeptidase, glycyl endopeptidase, human rhinovirus 3C protease, hypodermin C, IgA-specific serine endopeptidase, leucyl aminopeptidase, leucyl endopeptidase, lysC, lysosomal pro-X carboxypeptidase, lysyl aminopeptidase, methionyl aminopeptidase, myxobacter, nardilysin, pancreatic endopeptidase E, picornain 2A, picornain 3C, proendopeptidase, prolyl aminopeptidase, proprotein convertase I, proprotein convertase II, russellysin, saccharopepsin, semenogelase, T-plasminogen activator, thrombin, tissue kallikrein, tobacco etch virus (TEV), togavirin, tryptophanyl aminopeptidase, U-plasminogen activator, V8, venombin A, venombin AB, and Xaa-pro aminopeptidase.

For example, the proteolytically cleavable linker can comprise a matrix metalloproteinase cleavage site, e.g., a cleavage site for a MMP selected from collagenase-1, -2, and -3 (MMP-1, -8, and -13), gelatinase A and B (MMP-2 and -9), stromelysin 1, 2, and 3 (MMP-3, -10, and -11), matrilysin (MMP-7), and membrane metalloproteinases (MT1-MMP and MT2-MMP). For example, the cleavage sequence of MMP-9 is Pro-X-X-Hy (wherein, X represents an arbitrary residue; Hy, a hydrophobic residue; SEQ ID NO:70), e.g., Pro-X-X-Hy-(Ser/Thr) SEQ ID NO:71, e.g., Pro-Leu/Gln-Gly-Met-Thr-Ser (SEQ ID NO:72) or Pro-Leu/Gln-Gly-Met-Thr (SEQ ID NO:73). Another example of a protease cleavage site is a plasminogen activator cleavage site, e.g., a uPA or a tissue plasminogen activator (tPA) cleavage site. Another example of a suitable protease cleavage site is a prolactin cleavage site. Specific examples of cleavage sequences of uPA and tPA include sequences comprising Val-Gly-Arg. Another example of a protease cleavage site that can be included in a proteolytically cleavable linker is a tobacco etch virus (TEV) protease cleavage site, e.g., ENLYTQS (SEQ ID NO:6), where the protease cleaves between the glutamine and the serine. Another example of a protease cleavage site that can be included in a proteolytically cleavable linker is an enterokinase cleavage site, e.g., DDDDK (SEQ ID NO:7), where cleavage occurs after the lysine residue. Another example of a protease cleavage site that can be included in a proteolytically cleavable linker is a thrombin cleavage site, e.g., LVPR (SEQ ID NO:8). Additional suitable linkers comprising protease cleavage sites include linkers comprising one or more of the following amino acid sequences: LEVLFQGP (SEQ ID NO:5), cleaved by PreScission protease (a fusion protein comprising human rhinovirus 3C protease and glutathione-S-transferase; Walker et al. (1994) Biotechnol. 12:601); a thrombin cleavage site, e.g., CGLVPAGSGP (SEQ ID NO:30); SLLKSRMVPNFN (SEQ ID NO:31) or SLLIARRMPNFN (SEQ ID NO:32), cleaved by cathepsin B; SKLVQASASGVN (SEQ ID NO:33) or SSYLKAS-DAPDN (SEQ ID NO:34), cleaved by an Epstein-Barr virus protease; RPKPQQFFGLMN (SEQ ID NO:35) cleaved by MMP-3 (stromelysin); SLRPLALWRSFN (SEQ ID NO:36) cleaved by MMP-7 (matrilysin); SPQGIAGQRNFN (SEQ ID NO:37) cleaved by MMP-9; DVDERDVRGFASFL SEQ ID NO:38) cleaved by a thermolysin-like MMP; SLPLGL-WAPNFN (SEQ ID NO:39) cleaved by matrix metalloproteinase 2(MMP-2); SLLIFRSWANFN (SEQ ID NO:40) cleaved by cathespin L; SGVVIATVIVIT (SEQ ID NO:41) cleaved by cathepsin D; SLGPQGIWGQFN (SEQ ID NO:42) cleaved by matrix metalloproteinase 1(MMP-1); KKSPGRVVGGSV (SEQ ID NO:43) cleaved by urokinase-type plasminogen activator; PQGLLGAPGILG (SEQ ID NO:44) cleaved by membrane type 1 matrixmetalloproteinase (MT-MMP); HGPEGLRVGFYESDVMGRGHAR-LVHVEEPHT (SEQ ID NO:45) cleaved by stromelysin 3 (or MMP-11), thermolysin, fibroblast collagenase and stromelysin-1; GPQGLAGQRGIV (SEQ ID NO:46) cleaved by matrix metalloproteinase 13 (collagenase-3); GGSGQRGRKALE (SEQ ID NO:47) cleaved by tissue-type plasminogen activator(tPA); SLSALLSSDIFN (SEQ ID NO:48) cleaved by human prostate-specific antigen; SLPRFKIIGGFN (SEQ ID NO:49) cleaved by kallikrein (hK3); SLLGIAVPGNFN (SEQ ID NO:50) cleaved by neutrophil elastase; and FFKNIVTPRTPP (SEQ ID NO:51) cleaved by calpain (calcium activated neutral protease).

The Fc region can be a human IgG1 Fc, a human IgG2 Fc, a human IgG3 Fc, a human IgG4 Fc, etc. In some cases, the Fc region comprises an amino acid sequence having at least about 70%, at least about 75%, at least about 80%, at least about 85%, at least about 90%, at least about 95%, at least about 98%, at least about 99%, or 100%, amino acid sequence identity to an amino acid sequence of an Fc region depicted in FIGS. 9A-9C. In some cases, the Fc region comprises an amino acid sequence having at least about 70%, at least about 75%, at least about 80%, at least about 85%, at least about 90%, at least about 95%, at least about 98%, at least about 99%, or 100%, amino acid sequence identity to the human IgG1 Fc polypeptide depicted in FIG. 9A. In some cases, the Fc region comprises an amino acid sequence having at least about 70%, at least about 75%, at least about 80%, at least about 85%, at least about 90%, at least about 95%, at least about 98%, at least about 99%, or 100%, amino acid sequence identity to the human IgG2 Fc polypeptide depicted in FIG. 9A; e.g., the Fc region comprises an amino acid sequence having at least about 70%, at least about 75%, at least about 80%, at least about 85%, at least about 90%, at least about 95%, at least about 98%, at least about 99%, or 100%, amino acid sequence identity to amino acids 99-325 of the human IgG2 Fc polypeptide depicted in FIG. 9A. In some cases, the Fc region comprises an amino acid sequence having at least about 70%, at least about 75%, at least about 80%, at least about 85%, at least about 90%, at least about 95%, at least about 98%, at least about 99%, or 100%, amino acid sequence identity to the human IgG3 Fc polypeptide depicted in FIG. 9A; e.g., the Fc region comprises an amino acid sequence having at least about 70%, at least about 75%, at least about 80%, at least about 85%, at least about 90%, at least about 95%, at least about 98%, at least about 99%, or 100%, amino acid sequence identity to amino acids 19-246 of the human IgG3 Fc polypeptide depicted in FIG. 9A.

In some cases, a nucleic acid of the present disclosure comprises a nucleotide sequence encoding a fusion protein comprising, in order from N-terminus to C-terminus: a) an Ig Fc region; b) a proteolytically cleavable linker comprising the amino acid sequence LEVLFQGP (SEQ ID NO:5) and having a length of from 8 amino acids to 15 amino acids; and c) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In other cases, the variant HCV E2 polypeptide comprises, in order from N-terminus to C-terminus: i) the heterologous polypeptide comprising the one or more T cell epitopes; and ii) the HCV E2 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adeno-associated virus vector; an adenovirus vector; a retroviral vector; a non-viral vector; etc.).

In some cases, a nucleic acid of the present disclosure comprises a nucleotide sequence encoding a fusion protein comprising, in order from N-terminus to C-terminus: a) an Ig Fc region; b) a proteolytically cleavable linker comprising the amino acid sequence ENLYTQS (SEQ ID NO:6) and having a length of from 7 amino acids to 12 amino acids; and c) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In other cases, the variant HCV E2 polypeptide comprises, in order from N-terminus to C-terminus: i) the heterologous polypeptide comprising the one or more T cell epitopes; and ii) the HCV E2 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adenoassociated virus vector; an adenovirus vector; a retroviral vector; a non-viral vector; etc.).

In some cases, a nucleic acid of the present disclosure comprises a nucleotide sequence encoding an E1/E2 polypeptide comprising, in order from N-terminus to C-terminus: a) an HCV E1 polypeptide; and b) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In other cases, the variant HCV E2 polypeptide comprises, in order from N-terminus to C-terminus: i) the heterologous polypeptide comprising the one or more T cell epitopes; and ii) the HCV E2 polypeptide. In some cases, the nucleotide sequence encoding the E1/E2 polypeptide is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adenoassociated virus vector; an adenovirus vector; a retroviral vector; a non-viral vector; etc.). In some cases, the E1/E2 polypeptide comprises a host-derived signal peptidase cleavage site between the HCV E1 polypeptide and the variant HCV E2 polypeptide. Thus, in some cases, a nucleic acid of the present disclosure comprises a nucleotide sequence encoding an E1/E2 polypeptide comprising, in order from N-terminus to C-terminus: a) an HCV E1 polypeptide; b) a host signal peptidase cleavage site; and c) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In other cases, the variant HCV E2 polypeptide comprises, in order from N-terminus to C-terminus: i) the heterologous polypeptide comprising the one or more T cell epitopes; and ii) the HCV E2 polypeptide.

In some cases, a nucleic acid of the present disclosure comprises a nucleotide sequence encoding an E1/E2 polypeptide comprising, in order from N-terminus to C-terminus: a) an HCV E1 polypeptide; b) an Ig Fc region; and c) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In other cases, the variant HCV E2 polypeptide comprises, in order from N-terminus to C-terminus: i) the heterologous polypeptide comprising the one or more T cell epitopes; and ii) the HCV E2 polypeptide. In some cases, the nucleotide sequence encoding the E1/E2 polypeptide is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adenoassociated virus vector; an adenovirus vector; a retroviral vector; a non-viral vector; etc.). In some cases, the E1/E2 polypeptide comprises a host-derived signal peptidase cleavage site between the E1 polypeptide and the Ig Fc region. Thus, in some cases, a nucleic acid of the present disclosure comprises a nucleotide sequence encoding an E1/E2 polypeptide comprising, in order from N-terminus to C-terminus: a) an HCV E1 polypeptide; b) a host-derived signal peptidase cleavage site; c) an Ig Fc region; and d) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In other cases, the variant HCV E2 polypeptide comprises, in order from N-terminus to C-terminus: i) the heterologous polypeptide comprising the one or more T cell epitopes; and ii) the HCV E2 polypeptide. In some cases, a nucleotide sequence encoding from 2 to 10 amino acids (e.g., 2 aa, 3 aa, 4 aa, 5 aa, 6 aa, 7 aa, 8 aa, 9 aa, or 10 aa) of the N-terminus of an E2 polypeptide is interposed between the E1-encoding nucleotide sequence and the Ig Fc-encoding nucleotide sequence. Examples are depicted in FIG. 5A. For example, in some cases, a nucleotide sequence encoding QT, ET, HT, GT, TT, RH, NT, AY, VI, or ST is interposed between the E1-encoding nucleotide sequence and the Ig Fc-encoding nucleotide sequence. In some cases, a nucleotide sequence encoding ET (Glu-Thr) is interposed between the E1-encoding nucleotide sequence and the Ig Fc-encoding nucleotide sequence. In some cases, a nucleotide sequence encoding QT (Gln-Thr) is interposed between the E1-encoding nucleotide sequence and the Ig Fc-encoding nucleotide sequence. In some cases, a nucleotide sequence encoding TT (Thr-Thr) is interposed between the E1-encoding nucleotide sequence and the Ig Fc-encoding nucleotide sequence. In some cases, a nucleotide sequence encoding GT (Gly-Thr) is interposed between the E1-encoding nucleotide sequence and the Ig Fc-encoding nucleotide sequence. In some cases, a nucleotide sequence encoding HT (His-Thr) is interposed between the E1-encoding nucleotide sequence and the Ig Fc-encoding nucleotide sequence. In some cases, a nucleotide sequence encoding NT (Asn-Thr) is interposed between the E1-encoding nucleotide sequence and the Ig Fc-encoding nucleotide sequence. In some cases, a nucleotide sequence encoding VT (Val-Thr) is interposed between the E1-encoding nucleotide sequence and the Ig Fc-encoding nucleotide sequence. In some cases, a nucleotide sequence encoding ST (Ser-Thr) is interposed between the E1-encoding nucleotide sequence and the Ig Fc-encoding nucleotide sequence.

In some Fc tagged E1E2 constructs (with or without TP insertion), the duplication of the first two amino acids of E2 is such that an amino acid is created at the N-terminus of E2 following processing by signal peptidase (SP) (FIG. 5A). Such amino acids at the amino terminus include asparagine (N), glutamine (Q) or cysteine (C). Such amino acids can target the protein for proteasome-mediated degradation via the N-end rule pathway (reviewed in: Tasaki T et al. 2012. *Annu Rev Biochem* 81 261-289). For example in FIGS. 5A-5B: the insertion of QT in Avila129 (1A) creates an N-terminal glutamine (Q) residue following cleavage by signal peptidase. In this case, an alternative amino acid could be selected according to either the consensus sequence for the particular genotype or a particular genotype subclass (eg: genotype 1A in this case). The final purified E1E2 protein containing an N-terminal polytope addition (TPx) from Fc tagged E1E2 constructs contains an N-terminal glycine (G) residue and is not expected to be a substrate for the N-end rule pathway.

In some cases, a nucleic acid of the present disclosure comprises a nucleotide sequence encoding an E1/E2 polypeptide comprising, in order from N-terminus to C-terminus: a) an HCV E1 polypeptide; b) an Ig Fc region; c) a proteolytically cleavable linker; and d) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In other cases, the variant HCV E2 polypeptide comprises, in order from N-terminus to C-terminus: i) the heterologous polypeptide comprising the one or more T cell epitopes; and ii) the HCV E2 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adenoassociated virus vector; an adenovirus vector; a retroviral vector; a non-viral vector; etc.). In some cases, the E1/E2 polypeptide comprises a host-derived signal peptidase cleavage site between the E1 polypeptide and the Ig Fc region. Thus, in some cases, a nucleic acid of the present disclosure comprises a nucleotide sequence encoding an E1/E2 polypeptide comprising, in order from N-terminus to C-terminus: a) an HCV E1 polypeptide; b) a host-derived signal peptidase cleavage site; c) an Ig Fc region; d) a proteolytically cleavable linker; and e) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In other cases, the variant HCV E2 polypeptide comprises, in order from N-terminus to C-terminus: i) the heterologous polypeptide comprising the one or more T cell epitopes; and ii) the HCV E2 polypeptide. In some cases, a nucleotide sequence encoding from 2 to 10 amino acids (e.g., 2 aa, 3 aa, 4 aa, 5 aa, 6 aa, 7 aa, 8 aa, 9 aa, or 10 aa) of the N-terminus of an E2 polypeptide is interposed between the E1-encoding nucleotide sequence and the Ig Fc-encoding nucleotide sequence. Examples are depicted in FIG. 5A. For example, in some cases, a nucleotide sequence encoding QT, ET, HT, GT, TT, RH, NT, AY, VI, or ST is interposed between the E1-encoding nucleotide sequence and the Ig Fc-encoding nucleotide sequence. In some cases, a nucleotide sequence encoding ET (Glu-Thr) is interposed between the E1-encoding nucleotide sequence and the Ig Fc-encoding nucleotide sequence. In some cases, a nucleotide sequence encoding QT (Gln-Thr) is interposed between the E1-encoding nucleotide sequence and the Ig Fc-encoding nucleotide sequence. In some cases, a nucleotide sequence encoding TT (Thr-Thr) is interposed between the E1-encoding nucleotide sequence and the Ig Fc-encoding nucleotide sequence. In some cases, a nucleotide sequence encoding GT (Gly-Thr) is interposed between the E1-encoding nucleotide sequence and the Ig Fc-encoding nucleotide sequence. In some cases, a nucleotide sequence encoding HT (His-Thr) is interposed between the E1-encoding nucleotide sequence and the Ig Fc-encoding nucleotide sequence. In some cases, a nucleotide sequence encoding NT (Asn-Thr) is interposed between the E1-encoding nucleotide sequence and the Ig Fc-encoding nucleotide sequence. In some cases, a nucleotide sequence encoding VT (Val-Thr) is interposed between the E1-encoding nucleotide sequence and the Ig Fc-encoding nucleotide sequence. In some cases, a nucleotide sequence encoding ST (Ser-Thr) is interposed between the E1-encoding nucleotide sequence and the Ig Fc-encoding nucleotide sequence.

In some cases, a nucleic acid of the present disclosure comprises a nucleotide sequence encoding an E1/E2 polypeptide comprising, in order from N-terminus to C-terminus: a) an HCV E1 polypeptide; b) an Ig Fc region; c) a proteolytically cleavable linker comprising the amino acid sequence LEVLFQGP (SEQ ID NO:5) and having a length of from 8 amino acids to 15 amino acids; and d) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In other cases, the variant HCV E2 polypeptide comprises, in order from N-terminus to C-terminus: i) the heterologous polypeptide comprising the one or more T cell epitopes; and ii) the HCV E2 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adeno-associated virus vector; an adenovirus vector; a retroviral vector; a non-viral vector; etc.). In some cases, the E1/E2 polypeptide comprises a host-derived signal peptidase cleavage site between the E1 polypeptide and the Ig Fc region. Thus, in some cases, a nucleic acid of the present disclosure comprises a nucleotide sequence encoding an E1/E2 polypeptide comprising, in order from N-terminus to C-terminus: a) an HCV E1 polypeptide; b) a host-derived signal peptidase cleavage site; c) an Ig Fc region; d) a proteolytically cleavable linker comprising the amino acid sequence LEVLFQGP (SEQ ID NO:5) and having a length of from 8 amino acids to 15 amino acids; and e) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In other cases, the variant HCV E2 polypeptide comprises, in order from N-terminus to C-terminus: i) the heterologous polypeptide comprising the one or more T cell epitopes; and ii) the HCV E2 polypeptide. In some cases, a nucleotide sequence encoding from 2 to 10 amino acids (e.g., 2 aa, 3 aa, 4 aa, 5 aa, 6 aa, 7 aa, 8 aa, 9 aa, or 10 aa) of the N-terminus of an E2 polypeptide is interposed between the E1-encoding nucleotide sequence and the Ig Fc-encoding nucleotide sequence. Examples are depicted in FIG. 5A. For example, in some cases, a nucleotide sequence encoding QT, ET, HT, GT, TT, RH, NT, AY, VI, or ST is interposed between the E1-encoding nucleotide sequence and the Ig Fc-encoding nucleotide sequence. In some cases, a nucleotide sequence encoding ET (Glu-Thr) is interposed between the E1-encoding nucleotide sequence and the Ig Fc-encoding nucleotide sequence. In some cases, a nucleotide sequence encoding QT (Gln-Thr) is interposed between the E1-encoding nucleotide sequence and the Ig Fc-encoding nucleotide sequence. In some cases, a nucleotide sequence encoding TT (Thr-Thr) is interposed between the E1-encoding nucleotide sequence and the Ig Fc-encoding nucleotide sequence. In some cases, a nucleotide sequence encoding GT (Gly-Thr) is interposed between the E1-encoding nucleotide sequence and the Ig Fc-encoding nucleotide sequence. In some cases, a nucleotide sequence encoding HT (His-Thr) is interposed between the E1-encoding nucleotide sequence and the Ig Fc-encoding nucleotide sequence. In some cases, a nucleotide sequence encoding NT (Asn-Thr) is interposed between the E1-encoding nucleotide sequence and the Ig Fc-encoding nucleotide sequence. In some cases, a nucleotide sequence encoding VT (Val-Thr) is interposed between the E1-encoding nucleotide sequence and the Ig Fc-encoding nucleotide sequence. In some cases, a nucleotide sequence encoding ST (Ser-Thr) is interposed between the E1-encoding nucleotide sequence and the Ig Fc-encoding nucleotide sequence.

In some cases, a nucleic acid of the present disclosure comprises a nucleotide sequence encoding an E1/E2 polypeptide comprising, in order from N-terminus to C-terminus: a) an HCV E1 polypeptide; b) an Ig Fc region; c) a proteolytically cleavable linker comprising the amino acid sequence ENLYTQS (SEQ ID NO:6) and having a length of from 7 amino acids to 12 amino acids; and d) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In other cases, the variant HCV E2 polypeptide comprises, in order from N-terminus to C-terminus: i) the heterologous polypeptide comprising the one or more T cell epitopes; and ii) the HCV E2 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adeno-associated virus vector; an adenovirus vector; a retroviral vector; a non-viral vector; etc.). In some cases, the E1/E2 polypeptide comprises a host-derived signal peptidase cleavage site between the E1 polypeptide and the Ig Fc region. Thus, in some cases, a nucleic acid of the present disclosure comprises a nucleotide sequence encoding an E1/E2 polypeptide comprising, in order from N-terminus to C-terminus: a) an HCV E1 polypeptide; b) a host-derived signal peptidase cleavage site; c) an Ig Fc region; d) a proteolytically cleavable linker comprising the amino acid sequence ENLYTQS (SEQ ID NO:6) and having a length of from 7 amino acids to 12 amino acids; and e) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In other cases, the variant HCV E2 polypeptide comprises, in order from N-terminus to C-terminus: i) the heterologous polypeptide comprising the one or more T cell epitopes; and ii) the HCV E2 polypeptide. In some cases, a nucleotide sequence encoding from 2 to 10 amino acids (e.g., 2 aa, 3 aa, 4 aa, 5 aa, 6 aa, 7 aa, 8 aa, 9 aa, or 10 aa) of the N-terminus of an E2 polypeptide is interposed between the E1-encoding nucleotide sequence and the Ig Fc-encoding nucleotide sequence. Examples are depicted in FIG. 5A. For example, in some cases, a nucleotide sequence encoding QT, ET, HT, GT, TT, RH, NT, AY, VI, or ST is interposed between the E1-encoding nucleotide sequence and the Ig Fc-encoding nucleotide sequence. In some cases, a nucleotide sequence encoding ET (Glu-Thr) is interposed between the E1-encoding nucleotide sequence and the Ig Fc-encoding nucleotide sequence. In some cases, a nucleotide sequence encoding QT (Gln-Thr) is interposed between the E1-encoding nucleotide sequence and the Ig Fc-encoding nucleotide sequence. In some cases, a nucleotide sequence encoding TT (Thr-Thr) is interposed between the E1-encoding nucleotide sequence and the Ig Fc-encoding nucleotide sequence. In some cases, a nucleotide sequence encoding GT (Gly-Thr) is interposed between the E1-encoding nucleotide sequence and the Ig Fc-encoding nucleotide sequence. In some cases, a nucleotide sequence encoding HT (His-Thr) is interposed between the E1-encoding nucleotide sequence and the Ig Fc-encoding nucleotide sequence. In some cases, a nucleotide sequence encoding NT (Asn-Thr) is interposed between the E1-encoding nucleotide sequence and the Ig Fc-encoding nucleotide sequence. In some cases, a nucleotide sequence encoding VT (Val-Thr) is interposed between the E1-encoding nucleotide sequence and the Ig Fc-encoding nucleotide sequence.

In some cases, a nucleotide sequence encoding ST (Ser-Thr) is interposed between the E1-encoding nucleotide sequence and the Ig Fc-encoding nucleotide sequence.

In some cases, a nucleic acid of the present disclosure comprises a nucleotide sequence encoding an E1/E2 polypeptide comprising, in order from N-terminus to C-terminus: a) a signal peptide that directs the E1/E2 polypeptide to the endoplasmic reticulum (ER) following translation of the E1/E2 polypeptide; b) an HCV E1 polypeptide; c) an Ig Fc region; d) a proteolytically cleavable linker; and e) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In other cases, the variant HCV E2 polypeptide comprises, in order from N-terminus to C-terminus: i) the heterologous polypeptide comprising the one or more T cell epitopes; and ii) the HCV E2 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adeno-associated virus vector; an adenovirus vector; a retroviral vector; a non-viral vector; etc.). In some cases, the E1/E2 polypeptide comprises a host-derived signal peptidase cleavage site between the E1 polypeptide and the Ig Fc region, and comprises a host-derived signal peptidase cleavage site between the signal peptide and the HCV E1 polypeptide. Thus, in some cases, a nucleic acid of the present disclosure comprises a nucleotide sequence encoding an E1/E2 polypeptide comprising, in order from N-terminus to C-terminus: a) a signal peptide that directs the E1/E2 polypeptide to the ER following translation of the E1/E2 polypeptide; b) a host-derived signal peptidase cleavage site; c) an HCV E1 polypeptide; d) a host-derived signal peptidase cleavage site; e) an Ig Fc region; f) a proteolytically cleavable linker; and g) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In other cases, the variant HCV E2 polypeptide comprises, in order from N-terminus to C-terminus: i) the heterologous polypeptide comprising the one or more T cell epitopes; and ii) the HCV E2 polypeptide. In some cases, a nucleotide sequence encoding from 2 to 10 amino acids (e.g., 2 aa, 3 aa, 4 aa, 5 aa, 6 aa, 7 aa, 8 aa, 9 aa, or 10 aa) of the N-terminus of an E2 polypeptide is interposed between the E1-encoding nucleotide sequence and the Ig Fc-encoding nucleotide sequence. Examples are depicted in FIG. 5A. For example, in some cases, a nucleotide sequence encoding QT, ET, HT, GT, TT, RH, NT, AY, VI, or ST is interposed between the E1-encoding nucleotide sequence and the Ig Fc-encoding nucleotide sequence. In some cases, a nucleotide sequence encoding ET (Glu-Thr) is interposed between the E1-encoding nucleotide sequence and the Ig Fc-encoding nucleotide sequence. In some cases, a nucleotide sequence encoding QT (Gln-Thr) is interposed between the E1-encoding nucleotide sequence and the Ig Fc-encoding nucleotide sequence. In some cases, a nucleotide sequence encoding TT (Thr-Thr) is interposed between the E1-encoding nucleotide sequence and the Ig Fc-encoding nucleotide sequence. In some cases, a nucleotide sequence encoding GT (Gly-Thr) is interposed between the E1-encoding nucleotide sequence and the Ig Fc-encoding nucleotide sequence. In some cases, a nucleotide sequence encoding HT (His-Thr) is interposed between the E1-encoding nucleotide sequence and the Ig Fc-encoding nucleotide sequence. In some cases, a nucleotide sequence encoding NT (Asn-Thr) is interposed between the E1-encoding nucleotide sequence and the Ig Fc-encoding nucleotide sequence. In some cases, a nucleotide sequence encoding VT (Val-Thr) is interposed between the E1-encoding nucleotide sequence and the Ig Fc-encoding nucleotide sequence. In some cases, a nucleotide sequence encoding ST (Ser-Thr) is interposed between the E1-encoding nucleotide sequence and the Ig Fc-encoding nucleotide sequence.

Suitable signal peptides include, e.g., a tissue plasminogen activator (tPA) signal peptide; an Ig kappa light chain precursor signal peptide; a serum albumin preproprotein signal peptide; an Immunoglobulin heavy chain signal peptide; an Immunoglobulin light chain signal peptide; an azuorcidin preproprotein signal peptide; a cystatin-S precursor signal peptide; a trypsinogen-2 precursor signal peptide; a chymotrypsinogen precursor signal peptide; and the like. (Bendtsen et al. (2004) *J. Mol. Biol.* 340 783-795; Kober et al. (2012) *Biotechnology and Bioengineering* 110(4) 1164-1173).

In some cases, a nucleic acid of the present disclosure comprises a nucleotide sequence encoding an E1/E2 polypeptide comprising, in order from N-terminus to C-terminus: a) a signal peptide that directs the E1/E2 polypeptide to the endoplasmic reticulum (ER) following translation of the E1/E2 polypeptide; b) an HCV E1 polypeptide; c) an Ig Fc region; d) a proteolytically cleavable linker comprising the amino acid sequence LEVLFQGP (SEQ ID NO:5) and having a length of from 8 amino acids to 15 amino acids; and e) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In other cases, the variant HCV E2 polypeptide comprises, in order from N-terminus to C-terminus: i) the heterologous polypeptide comprising the one or more T cell epitopes; and ii) the HCV E2 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adeno-associated virus vector; an adenovirus vector; a retroviral vector; a non-viral vector; etc.). In some cases, the E1/E2 polypeptide comprises a host-derived signal peptidase cleavage site between the E1 polypeptide and the Ig Fc region, and comprises a host-derived signal peptidase cleavage site between the signal peptide and the HCV E1 polypeptide. Thus, in some cases, a nucleic acid of the present disclosure comprises a nucleotide sequence encoding an E1/E2 polypeptide comprising, in order from N-terminus to C-terminus: a) a signal peptide that directs the E1/E2 polypeptide to the endoplasmic reticulum (ER) following translation of the E1/E2 polypeptide; b) a host-derived signal peptidase cleavage site; c) an HCV E1 polypeptide; d) a host-derived signal peptidase cleavage site; e) an Ig Fc region; f) a proteolytically cleavable linker comprising the amino acid sequence LEVLFQGP (SEQ ID NO:5) and having a length of from 8 amino acids to 15 amino acids; and g) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In other cases, the variant HCV E2 polypeptide comprises, in order from N-terminus to C-terminus: i) the heterologous polypeptide comprising the one or more T cell epitopes; and ii) the HCV E2 polypeptide. In some cases, a nucleotide sequence encoding from 2 to 10 amino acids (e.g., 2 aa, 3 aa, 4 aa, 5 aa, 6 aa, 7 aa, 8 aa, 9 aa, or 10 aa) of the N-terminus of an E2 polypeptide is interposed between the E1-encoding nucleotide sequence and the Ig Fc-encoding nucleotide sequence. Examples are depicted in FIG. 5A. For example, in some cases, a nucleotide sequence encoding QT, ET, HT, GT, TT, RH, NT, AY, VI, or ST is interposed between the E1-encoding nucleotide sequence and the Ig Fc-encoding nucleotide sequence. In some cases, a nucleotide sequence encoding ET (Glu-Thr) is interposed between the E1-encoding nucleotide sequence and the Ig Fc-encoding nucleotide sequence. In some cases, a nucleotide sequence encoding QT (Gln-Thr) is interposed between the E1-encoding nucleotide sequence and the Ig Fc-encoding nucleotide sequence. In some cases, a nucleotide sequence encoding TT (Thr-Thr) is interposed between the E1-encoding nucleotide sequence and the Ig Fc-encoding nucleotide sequence. In some cases, a nucleotide sequence encoding GT (Gly-Thr) is interposed between the E1-encoding nucleotide sequence and the Ig Fc-encoding nucleotide sequence. In some cases, a nucleotide sequence encoding HT (His-Thr) is interposed between the E1-encoding nucleotide sequence and the Ig Fc-encoding nucleotide sequence. In some cases, a nucleotide sequence encoding NT (Asn-Thr) is interposed between the E1-encoding nucleotide sequence and the Ig Fc-encoding nucleotide sequence. In some cases, a nucleotide sequence encoding VT (Val-Thr) is interposed between the E1-encoding nucleotide sequence and the Ig Fc-encoding nucleotide sequence. In some cases, a nucleotide sequence encoding ST (Ser-Thr) is interposed between the E1-encoding nucleotide sequence and the Ig Fc-encoding nucleotide sequence.

In some cases, a nucleic acid of the present disclosure comprises a nucleotide sequence encoding an E1/E2 polypeptide comprising, in order from N-terminus to C-terminus: a) a signal peptide that directs the E1/E2 polypeptide to the endoplasmic reticulum (ER) following translation of the E1/E2 polypeptide; b) an HCV E1 polypeptide; c) an Ig Fc region; d) a proteolytically cleavable linker comprising the amino acid sequence ENLYTQS (SEQ ID NO:6) and having a length of from 7 amino acids to 12 amino acids; and e) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In other cases, the variant HCV E2 polypeptide comprises, in order from N-terminus to C-terminus: i) the heterologous polypeptide comprising the one or more T cell epitopes; and ii) the HCV E2 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adeno-associated virus vector; an adenovirus vector; a retroviral vector; a non-viral vector; etc.). In some cases, the E1/E2 polypeptide comprises a host-derived signal peptidase cleavage site between the E1 polypeptide and the Ig Fc region, and comprises a host-derived signal peptidase cleavage site between the signal peptide and the HCV E1 polypeptide. Thus, in some cases, a nucleic acid of the present disclosure comprises a nucleotide sequence encoding an E1/E2 polypeptide comprising, in order from N-terminus to C-terminus: a) a signal peptide that directs the E1/E2 polypeptide to the ER following translation of the E1/E2 polypeptide; b) a host-derived signal peptidase cleavage site; c) an HCV E1 polypeptide; d) a host-derived signal peptidase cleavage site; e) an Ig Fc region; f) a proteolytically cleavable linker comprising the amino acid sequence ENLYTQS (SEQ ID NO:6) and having a length of from 7 amino acids to 12 amino acids; and g) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E2 polypeptide comprises, in order from N-terminus to C-terminus: i) the HCV E2 polypeptide; and ii) the heterologous polypeptide comprising the one or more T cell epitopes. In other cases, the variant HCV E2 polypeptide comprises, in order from N-terminus to C-terminus: i) the heterologous polypeptide comprising the one or more T cell epitopes; and ii) the HCV E2 polypeptide. In some cases, a nucleotide sequence encoding from 2 to 10 amino acids (e.g., 2 aa, 3 aa, 4 aa, 5 aa, 6 aa, 7 aa, 8 aa, 9 aa, or 10 aa) of the N-terminus of an E2 polypeptide is interposed between the E1-encoding nucleotide sequence and the Ig Fc-encoding nucleotide sequence. Examples are depicted in FIG. 5A. For example, in some cases, a nucleotide sequence encoding QT, ET, HT, GT, TT, RH, NT, AY, VI, or ST is interposed between the E1-encoding nucleotide sequence and the Ig Fc-encoding nucleotide sequence. In some cases, a nucleotide sequence encoding ET (Glu-Thr) is interposed between the E1-encoding nucleotide sequence and the Ig Fc-encoding nucleotide sequence. In some cases, a nucleotide sequence encoding QT (Gln-Thr) is interposed between the E1-encoding nucleotide sequence and the Ig Fc-encoding nucleotide sequence. In some cases, a nucleotide sequence encoding TT (Thr-Thr) is interposed between the E1-encoding nucleotide sequence and the Ig Fc-encoding nucleotide sequence. In some cases, a nucleotide sequence encoding GT (Gly-Thr) is interposed between the E1-encoding nucleotide sequence and the Ig Fc-encoding nucleotide sequence. In some cases, a nucleotide sequence encoding HT (His-Thr) is interposed between the E1-encoding nucleotide sequence and the Ig Fc-encoding nucleotide sequence. In some cases, a nucleotide sequence encoding NT (Asn-Thr) is interposed between the E1-encoding nucleotide sequence and the Ig Fc-encoding nucleotide sequence. In some cases, a nucleotide sequence encoding VT (Val-Thr) is interposed between the E1-encoding nucleotide sequence and the Ig Fc-encoding nucleotide sequence. In some cases, a nucleotide sequence encoding ST (Ser-Thr) is interposed between the E1-encoding nucleotide sequence and the Ig Fc-encoding nucleotide sequence.

As noted above, in some cases, a nucleic acid of the present disclosure is present in an expression vector. Thus, the present disclosure provides a recombinant expression vector comprising a nucleic acid comprising a nucleotide sequence encoding a variant E2 polypeptide of the present disclosure or comprising a nucleotide sequence encoding an E1/E2 heterodimer of the present disclosure. In some cases, the nucleotide sequence encoding the variant E2 polypeptide of the present disclosure or the nucleotide sequence encoding the E1/E2 heterodimer of the present disclosure is operably linked to a transcriptional control element, e.g., a promoter, such as a promoter functional in a eukaryotic cell.

Suitable expression vectors include, but are not limited to, baculovirus vectors, bacteriophage vectors, plasmids, phagemids, cosmids, fosmids, bacterial artificial chromosomes, viral vectors (e.g. viral vectors based on vaccinia virus, poliovirus, adenovirus, adeno-associated virus, SV40, herpes simplex virus, HIV-based lentivirus vectors, murine leukemia virus (MVL)-based gamma retrovirus vectors, and the like), P1-based artificial chromosomes, yeast plasmids, yeast artificial chromosomes, and any other vectors specific for specific hosts of interest (such as *E. coli*, mammalian cells, insect cells, or yeast cells).

IV(B). Variant E1 and E1/E2 Heterodimers Comprising a Variant E1 Polypeptide

The present disclosure provides a nucleic acid comprising a nucleotide sequence encoding a variant HCV E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). The present disclosure provides a nucleic acid comprising a nucleotide sequence encoding a polyprotein comprising a variant E1 polypeptide of the present disclosure. In some cases, the nucleic acid is present in an expression vector. Thus, the present disclosure provides a recombinant expression vector comprising a nucleotide sequence encoding a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide).

In some cases, a nucleic acid of the present disclosure comprises a nucleotide sequence encoding a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the nucleotide sequence encoding the variant E2 polypeptide is operably linked to a transcription control element, e.g., a promoter that is functional in a eukaryotic cell. Suitable promoters include, e.g., a cytomegalovirus (CMV) promoter, an SV40 promoter, and the like. In some cases, the nucleic acid is present in an expression vector (e.g., a lentivirus vector; an adenoassociated virus vector; an adenovirus vector; a retroviral vector; a non-viral vector; etc.). In some cases, the nucleic acid is present in an expression vector, where the expression vector is a non-viral vector.

In some cases, a nucleic acid of the present disclosure comprises a nucleotide sequence encoding a fusion protein comprising, in order from N-terminus to C-terminus: a) an immunoglobulin (Ig) Fc region; and b) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In some cases, the variant HCV E1 polypeptide comprises, in order from N-terminus to C-terminus: i) the heterologous polypeptide comprising the one or more T cell epitopes; and ii) the HCV E1 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adenoassociated virus vector; an adenovirus vector; a retroviral vector; a non-viral vector; etc.).

In some cases, a nucleic acid of the present disclosure comprises a nucleotide sequence encoding a fusion protein comprising, in order from N-terminus to C-terminus: a) an Ig Fc region; b) a proteolytically cleavable linker; and c) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In other cases, the variant HCV E1 polypeptide comprises, in order from N-terminus to C-terminus: i) the heterologous polypeptide comprising the one or more T cell epitopes; and ii) the HCV E1 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adenoassociated virus vector; an adenovirus vector; a retroviral vector; a non-viral vector; etc.).

The proteolytically cleavable linker can include a protease recognition sequence recognized by a protease selected from the group consisting of alanine carboxypeptidase, *Armillaria mellea* astacin, bacterial leucyl aminopeptidase, cancer procoagulant, cathepsin B, clostripain, cytosol alanyl aminopeptidase, elastase, endoproteinase Arg-C, enterokinase, gastricsin, gelatinase, Gly-X carboxypeptidase, glycyl endopeptidase, human rhinovirus 3C protease, hypodermin C, IgA-specific serine endopeptidase, leucyl aminopeptidase, leucyl endopeptidase, lysC, lysosomal pro-X carboxypeptidase, lysyl aminopeptidase, methionyl aminopeptidase, myxobacter, nardilysin, pancreatic endopeptidase E, picornain 2A, picornain 3C, proendopeptidase, prolyl aminopeptidase, proprotein convertase I, proprotein convertase II, russellysin, saccharopepsin, semenogelase, T-plasminogen activator, thrombin, tissue kallikrein, tobacco etch virus (TEV), togavirin, tryptophanyl aminopeptidase, U-plasminogen activator, V8, venombin A, venombin AB, and Xaa-pro aminopeptidase.

For example, the proteolytically cleavable linker can comprise a matrix metalloproteinase cleavage site, e.g., a cleavage site for a MMP selected from collagenase-1, -2, and -3 (MMP-1, -8, and -13), gelatinase A and B (MMP-2 and -9), stromelysin 1, 2, and 3 (MMP-3, -10, and -11), matrilysin (MMP-7), and membrane metalloproteinases (MT1-MMP and MT2-MMP). For example, the cleavage sequence of MMP-9 is Pro-X-X-Hy (wherein, X represents an arbitrary residue; Hy, a hydrophobic residue; SEQ ID NO:70), e.g., Pro-X-X-Hy-(Ser/Thr) SEQ ID NO:71, e.g., Pro-Leu/Gln-Gly-Met-Thr-Ser (SEQ ID NO:72) or Pro-Leu/Gln-Gly-Met-Thr (SEQ ID NO:73). Another example of a protease cleavage site is a plasminogen activator cleavage site, e.g., a uPA or a tissue plasminogen activator (tPA) cleavage site. In some cases, the cleavage site is afurin cleavage site. Specific examples of cleavage sequences of uPA and tPA include sequences comprising Val-Gly-Arg. Another example of a protease cleavage site that can be included in a proteolytically cleavable linker is a tobacco etch virus (TEV) protease cleavage site, e.g., ENLYTQS (SEQ ID NO:6), where the protease cleaves between the glutamine and the serine. Another example of a protease cleavage site that can be included in a proteolytically cleavable linker is an enterokinase cleavage site, e.g., DDDDK (SEQ ID NO:7), where cleavage occurs after the lysine residue. Another example of a protease cleavage site that can be included in a proteolytically cleavable linker is a thrombin cleavage site, e.g., LVPR (SEQ ID NO:8). Additional suitable linkers comprising protease cleavage sites include linkers comprising one or more of the following amino acid sequences: LEVLFQGP (SEQ ID NO:5), cleaved by PreScission protease (a fusion protein comprising human rhinovirus 3C protease and glutathione-S-transferase; Walker et al. (1994) Biotechnol. 12:601); a thrombin cleavage site, e.g., CGLVPAGSGP (SEQ ID NO:30); SLLKSRMVPNFN (SEQ ID NO:31) or SLLIARRMPNFN (SEQ ID NO:32), cleaved by cathepsin B; SKLVQASASGVN (SEQ ID NO:33) or SSYLKASDAPDN (SEQ ID NO:34), cleaved by an Epstein-Barr virus protease; RPKPQQFFGLMN (SEQ ID NO:35) cleaved by MMP-3 (stromelysin); SLRPLALWRSFN (SEQ ID NO:36) cleaved by MMP-7 (matrilysin); SPQGIAGQRNFN (SEQ ID NO:37) cleaved by MMP-9; DVDERDVRGFASFL SEQ ID NO:38) cleaved by a thermolysin-like MMP; SLPLGLWAPNFN (SEQ ID NO:39) cleaved by matrix metalloproteinase 2(MMP-2); SLLIFRSWANFN (SEQ ID NO:40) cleaved by cathespin L; SGVVIATVIVIT (SEQ ID NO:41) cleaved by cathepsin D; SLGPQGIWGQFN (SEQ ID NO:42) cleaved by matrix metalloproteinase 1(MMP-1); KKSPGRVVGGSV (SEQ ID NO:43) cleaved by urokinase-type plasminogen activator; PQGLLGAPGILG (SEQ ID NO:44) cleaved by membrane type 1 matrixmetalloproteinase (MT-MMP); HGPEGLRVGFYESDVMGRGHARLVHVEEPHT (SEQ ID NO:45) cleaved by stromelysin 3 (or MMP-11), thermolysin, fibroblast collagenase and stromelysin-1; GPQGLAGQRGIV (SEQ ID NO:46) cleaved by matrix metalloproteinase 13 (collagenase-3); GGSGQRGRKALE (SEQ ID NO:47) cleaved by tissue-type plasminogen activator(tPA); SLSAL- LSSDIFN (SEQ ID NO:48) cleaved by human prostate-specific antigen; SLPRFKIIGGFN (SEQ ID NO:49) cleaved by kallikrein (hK3); SLLGIAVPGNFN (SEQ ID NO:50) cleaved by neutrophil elastase; and FFKNIVTPRTPP (SEQ ID NO:51) cleaved by calpain (calcium activated neutral protease).

The Fc region can be a human IgG1 Fc, a human IgG2 Fc, a human IgG3 Fc, a human IgG4 Fc, etc. In some cases, the Fc region comprises an amino acid sequence having at least about 70%, at least about 75%, at least about 80%, at least about 85%, at least about 90%, at least about 95%, at least about 98%, at least about 99%, or 100%, amino acid sequence identity to an amino acid sequence of an Fc region depicted in FIGS. 9A-9C. In some cases, the Fc region comprises an amino acid sequence having at least about 70%, at least about 75%, at least about 80%, at least about 85%, at least about 90%, at least about 95%, at least about 98%, at least about 99%, or 100%, amino acid sequence identity to the human IgG1 Fc polypeptide depicted in FIG. 9A. In some cases, the Fc region comprises an amino acid sequence having at least about 70%, at least about 75%, at least about 80%, at least about 85%, at least about 90%, at least about 95%, at least about 98%, at least about 99%, or 100%, amino acid sequence identity to the human IgG2 Fc polypeptide depicted in FIG. 9A; e.g., the Fc region comprises an amino acid sequence having at least about 70%, at least about 75%, at least about 80%, at least about 85%, at least about 90%, at least about 95%, at least about 98%, at least about 99%, or 100%, amino acid sequence identity to amino acids 99-325 of the human IgG2 Fc polypeptide depicted in FIG. 9A. In some cases, the Fc region comprises an amino acid sequence having at least about 70%, at least about 75%, at least about 80%, at least about 85%, at least about 90%, at least about 95%, at least about 98%, at least about 99%, or 100%, amino acid sequence identity to the human IgG3 Fc polypeptide depicted in FIG. 9A; e.g., the Fc region comprises an amino acid sequence having at least about 70%, at least about 75%, at least about 80%, at least about 85%, at least about 90%, at least about 95%, at least about 98%, at least about 99%, or 100%, amino acid sequence identity to amino acids 19-246 of the human IgG3 Fc polypeptide depicted in FIG. 9A.

In some cases, a nucleic acid of the present disclosure comprises a nucleotide sequence encoding a fusion protein comprising, in order from N-terminus to C-terminus: a) an Ig Fc region; b) a proteolytically cleavable linker comprising the amino acid sequence LEVLFQGP (SEQ ID NO:5) and having a length of from 8 amino acids to 15 amino acids; and c) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In other cases, the variant HCV E1 polypeptide comprises, in order from N-terminus to C-terminus: i) the heterologous polypeptide comprising the one or more T cell epitopes; and ii) the HCV E1 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adeno-associated virus vector; an adenovirus vector; a retroviral vector; a non-viral vector; etc.).

In some cases, a nucleic acid of the present disclosure comprises a nucleotide sequence encoding a fusion protein comprising, in order from N-terminus to C-terminus: a) an Ig Fc region; b) a proteolytically cleavable linker comprising the amino acid sequence ENLYTQS (SEQ ID NO:6) and having a length of from 7 amino acids to 12 amino acids; and c) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In other cases, the variant HCV E1 polypeptide comprises, in order from N-terminus to C-terminus: i) the heterologous polypeptide comprising the one or more T cell epitopes; and ii) the HCV E1 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adeno-associated virus vector; an adenovirus vector; a retroviral vector; a non-viral vector; etc.).

In some cases, a nucleic acid of the present disclosure comprises a nucleotide sequence encoding an E1/E2 polypeptide comprising, in order from N-terminus to C-terminus: a) an HCV E2 polypeptide; and b) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In other cases, the variant HCV E1 polypeptide comprises, in order from N-terminus to C-terminus: i) the heterologous polypeptide comprising the one or more T cell epitopes; and ii) the HCV E1 polypeptide. In some cases, the nucleotide sequence encoding the E1/E2 polypeptide is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adenoassociated virus vector; an adenovirus vector; a retroviral vector; a non-viral vector; etc.). In some cases, the E1/E2 polypeptide comprises a host-derived signal peptidase cleavage site between the HCV E2 polypeptide and the variant HCV E1 polypeptide. Thus, in some cases, a nucleic acid of the present disclosure comprises a nucleotide sequence encoding an E1/E2 polypeptide comprising, in order from N-terminus to C-terminus: a) an HCV E2 polypeptide; b) a host signal peptidase cleavage site; and c) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In other cases, the variant HCV E1 polypeptide comprises, in order from N-terminus to C-terminus: i) the heterologous polypeptide comprising the one or more T cell epitopes; and ii) the HCV E1 polypeptide.

In some cases, a nucleic acid of the present disclosure comprises a nucleotide sequence encoding an E1/E2 polypeptide comprising, in order from N-terminus to C-terminus: a) an HCV E2 polypeptide; b) an Ig Fc region; and c) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In other cases, the variant HCV E1 polypeptide comprises, in order from N-terminus to C-terminus: i) the heterologous polypeptide comprising the one or more T cell epitopes; and ii) the HCV E1 polypeptide. In some cases, the nucleotide sequence encoding the E1/E2 polypeptide is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adenoassociated virus vector; an adenovirus vector; a retroviral vector; a non-viral vector; etc.). In some cases, the E1/E2 polypeptide comprises a host-derived signal peptidase cleavage site between the E2 polypeptide and the Ig Fc region. Thus, in some cases, a nucleic acid of the present disclosure comprises a nucleotide sequence encoding an E1/E2 polypeptide comprising, in order from N-terminus to C-terminus: a) an HCV E2 polypeptide; b) a host-derived signal peptidase cleavage site; c) an Ig Fc region; and d) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In other cases, the variant HCV E1 polypeptide comprises, in order from N-terminus to C-terminus: i) the heterologous polypeptide comprising the one or more T cell epitopes; and ii) the HCV E1 polypeptide.

In some cases, a nucleic acid of the present disclosure comprises a nucleotide sequence encoding an E1/E2 polypeptide comprising, in order from N-terminus to C-terminus: a) an HCV E2 polypeptide; b) an Ig Fc region; c) a proteolytically cleavable linker; and d) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In other cases, the variant HCV E1 polypeptide comprises, in order from N-terminus to C-terminus: i) the heterologous polypeptide comprising the one or more T cell epitopes; and ii) the HCV E1 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adenoassociated virus vector; an adenovirus vector; a retroviral vector; a non-viral vector; etc.). In some cases, the E1/E2 polypeptide comprises a host-derived signal peptidase cleavage site between the E2 polypeptide and the Ig Fc region. Thus, in some cases, a nucleic acid of the present disclosure comprises a nucleotide sequence encoding an E1/E2 polypeptide comprising, in order from N-terminus to C-terminus: a) an HCV E2 polypeptide; b) a host-derived signal peptidase cleavage site; c) an Ig Fc region; d) a proteolytically cleavable linker; and e) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In other cases, the variant HCV E1 polypeptide comprises, in order from N-terminus to C-terminus: i) the heterologous polypeptide comprising the one or more T cell epitopes; and ii) the HCV E1 polypeptide.

In some cases, a nucleic acid of the present disclosure comprises a nucleotide sequence encoding an E1/E2 polypeptide comprising, in order from N-terminus to C-terminus: a) an HCV E2 polypeptide; b) an Ig Fc region; c) a proteolytically cleavable linker comprising the amino acid sequence LEVLFQGP (SEQ ID NO:5) and having a length of from 8 amino acids to 15 amino acids; and d) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In other cases, the variant HCV E1 polypeptide comprises, in order from N-terminus to C-terminus: i) the heterologous polypeptide comprising the one or more T cell epitopes; and ii) the HCV E1 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adenoassociated virus vector; an adenovirus vector; a retroviral vector; a non-viral vector; etc.). In some cases, the E1/E2 polypeptide comprises a host-derived signal peptidase cleavage site between the E2 polypeptide and the Ig Fc region. Thus, in some cases, a nucleic acid of the present disclosure comprises a nucleotide sequence encoding an E1/E2 polypeptide comprising, in order from N-terminus to C-terminus: a) an HCV E2 polypeptide; b) a host-derived signal peptidase cleavage site; c) an Ig Fc region; d) a proteolytically cleavable linker comprising the amino acid sequence LEVLFQGP (SEQ ID NO:5) and having a length of from 8 amino acids to 15 amino acids; and e) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In other cases, the variant HCV E1 polypeptide comprises, in order from N-terminus to C-terminus: i) the heterologous polypeptide comprising the one or more T cell epitopes; and ii) the HCV E1 polypeptide.

In some cases, a nucleic acid of the present disclosure comprises a nucleotide sequence encoding an E1/E2 polypeptide comprising, in order from N-terminus to C-terminus: a) an HCV E2 polypeptide; b) an Ig Fc region; c) a proteolytically cleavable linker comprising the amino acid sequence ENLYTQS (SEQ ID NO:6) and having a length of from 7 amino acids to 12 amino acids; and d) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In other cases, the variant HCV E1 polypeptide comprises, in order from N-terminus to C-terminus: i) the heterologous polypeptide comprising the one or more T cell epitopes; and ii) the HCV E1 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adeno-associated virus vector; an adenovirus vector; a retroviral vector; a non-viral vector; etc.). In some cases, the E1/E2 polypeptide comprises a host-derived signal peptidase cleavage site between the E1 polypeptide and the Ig Fc region. Thus, in some cases, a nucleic acid of the present disclosure comprises a nucleotide sequence encoding an E1/E2 polypeptide comprising, in order from N-terminus to C-terminus: a) an HCV E2 polypeptide; b) a host-derived signal peptidase cleavage site; c) an Ig Fc region; d) a proteolytically cleavable linker comprising the amino acid sequence ENLYTQS (SEQ ID NO:6) and having a length of from 7 amino acids to 12 amino acids; and e) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In other cases, the variant HCV E1 polypeptide comprises, in order from N-terminus to C-terminus: i) the heterologous polypeptide comprising the one or more T cell epitopes; and ii) the HCV E1 polypeptide.

In some cases, a nucleic acid of the present disclosure comprises a nucleotide sequence encoding an E1/E2 polypeptide comprising, in order from N-terminus to C-terminus: a) a signal peptide that directs the E1/E2 polypeptide to the endoplasmic reticulum (ER) following translation of the E1/E2 polypeptide; b) an HCV E2 polypeptide; c) an Ig Fc region; d) a proteolytically cleavable linker; and e) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In other cases, the variant HCV E1 polypeptide comprises, in order from N-terminus to C-terminus: i) the heterologous polypeptide comprising the one or more T cell epitopes; and ii) the HCV E1 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adeno-associated virus vector; an adenovirus vector; a retroviral vector; a non-viral vector; etc.). In some cases, the E1/E2 polypeptide comprises a host-derived signal peptidase cleavage site between the E1 polypeptide and the Ig Fc region, and comprises a host-derived signal peptidase cleavage site between the signal peptide and the HCV E2 polypeptide. Thus, in some cases, a nucleic acid of the present disclosure comprises a nucleotide sequence encoding an E1/E2 polypeptide comprising, in order from N-terminus to C-terminus: a) a signal peptide that directs the E1/E2 polypeptide to the ER following translation of the E1/E2 polypeptide; b) a host-derived signal peptidase cleavage site; c) an HCV E2 polypeptide; d) a host-derived signal peptidase cleavage site; e) an Ig Fc region; f) a proteolytically cleavable linker; and g) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In other cases, the variant HCV E1 polypeptide comprises, in order from N-terminus to C-terminus: i) the heterologous polypeptide comprising the one or more T cell epitopes; and ii) the HCV E1 polypeptide.

In some cases, a nucleic acid of the present disclosure comprises a nucleotide sequence encoding an E1/E2 polypeptide comprising, in order from N-terminus to C-terminus: a) a signal peptide that directs the E1/E2 polypeptide to the endoplasmic reticulum (ER) following translation of the E1/E2 polypeptide; b) an HCV E2 polypeptide; c) an Ig Fc region; d) a proteolytically cleavable linker comprising the amino acid sequence LEVLFQGP (SEQ ID NO:5) and having a length of from 8 amino acids to 15 amino acids; and e) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In other cases, the variant HCV E1 polypeptide comprises, in order from N-terminus to C-terminus: i) the heterologous polypeptide comprising the one or more T cell epitopes; and ii) the HCV E1 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adeno-associated virus vector; an adenovirus vector; a retroviral vector; a non-viral vector; etc.). In some cases, the E1/E2 polypeptide comprises a host-derived signal peptidase cleavage site between the E2 polypeptide and the Ig Fc region, and comprises a host-derived signal peptidase cleavage site between the signal peptide and the HCV E2 polypeptide. Thus, in some cases, a nucleic acid of the present disclosure comprises a nucleotide sequence encoding an E1/E2 polypeptide comprising, in order from N-terminus to C-terminus: a) a signal peptide that directs the E1/E2 polypeptide to the endoplasmic reticulum (ER) following translation of the E1/E2 polypeptide; b) a host-derived signal peptidase cleavage site; c) an HCV E2 polypeptide; d) a host-derived signal peptidase cleavage site; e) an Ig Fc region; f) a proteolytically cleavable linker comprising the amino acid sequence LEVLFQGP (SEQ ID NO:5) and having a length of from 8 amino acids to 15 amino acids; and g) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In other cases, the variant HCV E1 polypeptide comprises, in order from N-terminus to C-terminus: i) the heterologous polypeptide comprising the one or more T cell epitopes; and ii) the HCV E1 polypeptide.

In some cases, a nucleic acid of the present disclosure comprises a nucleotide sequence encoding an E1/E2 polypeptide comprising, in order from N-terminus to C-terminus: a) a signal peptide that directs the E1/E2 polypeptide to the endoplasmic reticulum (ER) following translation of the E1/E2 polypeptide; b) an HCV E2 polypeptide; c) an Ig Fc region; d) a proteolytically cleavable linker comprising the amino acid sequence ENLYTQS (SEQ ID NO:6) and having a length of from 7 amino acids to 12 amino acids; and e) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In other cases, the variant HCV E1 polypeptide comprises, in order from N-terminus to C-terminus: i) the heterologous polypeptide comprising the one or more T cell epitopes; and ii) the HCV E1 polypeptide. In some cases, the nucleotide sequence encoding the fusion protein is operably linked to a transcription control element, e.g., a promoter that is functional in a eukaryotic cell. Suitable promoters include, e.g., a CMV promoter, an SV40 promoter, and the like. In some cases, the nucleic acid is present in an expression vector (e.g., a lentivirus vector; an adeno-associated virus vector; an adenovirus vector; a retroviral vector; a non-viral vector; etc.). In some cases, the E1/E2 polypeptide comprises a host-derived signal peptidase cleavage site between the E2 polypeptide and the Ig Fc region, and comprises a host-derived signal peptidase cleavage site between the signal peptide and the HCV E2 polypeptide. Thus, in some cases, a nucleic acid of the present disclosure comprises a nucleotide sequence encoding an E1/E2 polypeptide comprising, in order from N-terminus to C-terminus: a) a signal peptide that directs the E1/E2 polypeptide to the ER following translation of the E1/E2 polypeptide; b) a host-derived signal peptidase cleavage site; c) an HCV E2 polypeptide; d) a host-derived signal peptidase cleavage site; e) an Ig Fc region; f) a proteolytically cleavable linker comprising the amino acid sequence ENLYTQS (SEQ ID NO:6) and having a length of from 7 amino acids to 12 amino acids; and g) a variant E1 polypeptide of the present disclosure, where the variant HCV E1 polypeptide comprises: i) an HCV E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide). In some cases, the variant HCV E1 polypeptide comprises, in order from N-terminus to C-terminus: i) the HCV E1 polypeptide; and ii) the heterologous polypeptide comprising the one or more T cell epitopes. In other cases, the variant HCV E1 polypeptide comprises, in order from N-terminus to C-terminus: i) the heterologous polypeptide comprising the one or more T cell epitopes; and ii) the HCV E1 polypeptide.

As noted above, in some cases, a nucleic acid of the present disclosure is present in an expression vector. Thus, the present disclosure provides a recombinant expression vector comprising a nucleic acid comprising a nucleotide sequence encoding a variant E1 polypeptide of the present disclosure or comprising a nucleotide sequence encoding an E1/E2 heterodimer of the present disclosure. In some cases, the nucleotide sequence encoding the variant E1 polypeptide of the present disclosure or the nucleotide sequence encoding the E1/E2 heterodimer of the present disclosure is operably linked to a transcriptional control element, e.g., a promoter, such as a promoter functional in a eukaryotic cell.

Suitable expression vectors include, but are not limited to, baculovirus vectors, bacteriophage vectors, plasmids, phagemids, cosmids, fosmids, bacterial artificial chromosomes, viral vectors (e.g. viral vectors based on vaccinia virus, poliovirus, adenovirus, adeno-associated virus, SV40, herpes simplex virus, HIV-based lentivirus vectors, murine leukemia virus (MVL)-based gamma retrovirus vectors, and the like), P1-based artificial chromosomes, yeast plasmids, yeast artificial chromosomes, and any other vectors specific for specific hosts of interest (such as *E. coli*, mammalian cells, insect cells, or yeast cells).

Additional Embodiments

In some cases, a nucleic acid of the present disclosure comprises a first nucleotide sequence encoding a variant E2 polypeptide of the present disclosure, where the nucleotide sequence encodes a polypeptide comprising, from N-terminus to C-terminus: a) a variant HCV E2 polypeptide comprising, in order from N-terminus to C-terminus: i) an HCV E2 polypeptide; and ii) one or more T-cell epitopes from an HCV polypeptide other than E1 or E2; b) a proteolytically cleavable linker; and c) an Ig Fc polypeptide. In some cases, the nucleic acid further includes a second nucleotide sequence 5' of the first nucleotide sequence, where the second nucleotide sequence encodes an HCV E1 polypeptide. In some cases, the nucleic acid further includes a second nucleotide sequence 5' of the first nucleotide sequence, where the second nucleotide sequence encodes a varian HCV E1 polypeptide, the variant HCV E1 polypeptide comprising, in order from N-terminus to C-terminus: i) an HCV E1 polypeptide; and ii) one or more T-cell epitopes from an HCV polypeptide other than E1 or E2.

In some cases, a nucleic acid of the present disclosure comprises a nucleotide sequence encoding a variant E1 polypeptide of the present disclosure, where the nucleotide sequence encodes a polypeptide comprising, from N-terminus to C-terminus: a) a variant HCV E1 polypeptide comprising, in order from N-terminus to C-terminus: i) an HCV E1 polypeptide; and ii) one or more T-cell epitopes from an HCV polypeptide other than E1 or E2; b) a proteolytically cleavable linker; and c) an Ig Fc polypeptide. In some cases, the nucleic acid further includes a second nucleotide sequence 5' of the first nucleotide sequence, where the second nucleotide sequence encodes an HCV E2 polypeptide. In some cases, the nucleic acid further includes a second nucleotide sequence 5' of the first nucleotide sequence, where the second nucleotide sequence encodes a varian HCV E2 polypeptide, the variant HCV E2 polypeptide comprising, in order from N-terminus to C-terminus: i) an HCV E2 polypeptide; and ii) one or more T-cell epitopes from an HCV polypeptide other than E1 or E2.

In some cases, a nucleic acid of the present disclosure comprises a nucleotide sequence encoding a polypeptide comprising, from N-terminus to C-terminus: a) an Ig Fc polypeptide; b) a proteolytically cleavable linker; c) an HCV E1 polypeptide; d) two amino acids from the N-terminus of E2; and e) an HCV E2 polypeptide. In some cases, a nucleic acid of the present disclosure comprises a nucleotide sequence encoding a polypeptide comprising, from N-terminus to C-terminus: a) an Ig Fc polypeptide; b) a proteolytically cleavable linker; c) a variant HCV E1 polypeptide comprising, in order from N-terminus to C-terminus: i) an HCV E1 polypeptide; and ii) one or more T-cell epitopes from an HCV polypeptide other than E1 or E2; d) two amino acids from the N-terminus of E2; and e) an HCV E2 polypeptide. In some cases, a nucleic acid of the present disclosure comprises a nucleotide sequence encoding a polypeptide comprising, from N-terminus to C-terminus: a) an Ig Fc polypeptide; b) a proteolytically cleavable linker; c) a variant HCV E1 polypeptide comprising, in order from N-terminus to C-terminus: i) one or more T-cell epitopes from an HCV polypeptide other than E1 or E2; and ii) an HCV E1 polypeptide; d) two amino acids from the N-terminus of E2; and e) an HCV E2 polypeptide. In some cases, a nucleic acid of the present disclosure comprises a nucleotide sequence encoding a polypeptide comprising, from N-terminus to C-terminus: a) an Ig Fc polypeptide; b) a proteolytically cleavable linker; c) an HCV E1 polypeptide; d) two amino acids from the N-terminus of E2; and e) a variant HCV E2 polypeptide comprising, in order from N-terminus to C-terminus: i) an HCV E2 polypeptide; and ii) one or more T-cell epitopes from an HCV polypeptide other than E1 or E2. In some cases, a nucleic acid of the present disclosure comprises a nucleotide sequence encoding a polypeptide comprising, from N-terminus to C-terminus: a) an Ig Fc polypeptide; b) a proteolytically cleavable linker; c) an HCV E1 polypeptide; d) two amino acids from the N-terminus of E2; and e) a variant HCV E2 polypeptide comprising, in order from N-terminus to C-terminus: i) one or more T-cell epitopes from an HCV polypeptide other than E1 or E2; and ii) an HCV E2 polypeptide.

In any of the above-described embodiments, the nucleic acid can be included in a recombinant expression vector, as described above. Suitable proteolytically cleavable linkers are described above.

V. Host Cells

The present disclosure provides genetically modified host cells, where the genetically modified host cells are genetically modified with a nucleic acid or recombinant expression vector of the present disclosure.

Suitable host cells include eukaryotic cells, such as yeast cells, insect cells, and mammalian cells. In some cases, the host cell is a cell of a mammalian cell line. Suitable mammalian cell lines include human cell lines, non-human primate cell lines, rodent (e.g., mouse, rat) cell lines, and the like. Suitable mammalian cell lines include, but are not limited to, HeLa cells (e.g., American Type Culture Collection (ATCC) No. CCL-2), CHO cells (e.g., ATCC Nos. CRL9618, CCL61, CRL9096), 293 cells (e.g., ATCC No. CRL-1573), Vero cells, NIH 3T3 cells (e.g., ATCC No. CRL-1658), Huh-7 cells, BHK cells (e.g., ATCC No. CCL10), PC12 cells (ATCC No. CRL1721), COS cells, COS-7 cells (ATCC No. CRL1651), RAT1 cells, mouse L cells (ATCC No. CCLI.3), human embryonic kidney (HEK) cells (ATCC No. CRL1573), HLHepG2 cells, MRC4 fibroblast cells, and the like.

Methods for introduction of nucleic acids into host cells include, for example, transformation, electroporation, conjugation, calcium phosphate methods and the like. The method for transfer can be selected so as to provide for stable expression of the introduced polypeptide-encoding nucleic acid. The polypeptide-encoding nucleic acid can be provided as an inheritable episomal element (e.g., a plasmid) or can be genomically-integrated.

Methods of Producing a Variant E2 Polypeptide, a Variant E1 Polypeptide, or an E1/E2 Heterodimer E1, E2, variant E2, variant E1, and E1/E2 polypeptides can be produced using any suitable method, including recombinant and non-recombinant methods (e.g., chemical synthesis).

Where a polypeptide is chemically synthesized, the synthesis may proceed via liquid phase or solid-phase. Solid-phase peptide synthesis (SPPS) allows the incorporation of unnatural amino acids and/or peptide/protein backbone modification. Various forms of SPPS, such as Fmoc and Boc, are available for synthesizing polypeptides. Details of the chemical synthesis are known in the art (e.g., Ganesan A. 2006 Mini Rev. Med Chem. 6:3-10 and Camarero J A et al. 2005 Protein Pept Lett. 12:723-8).

Where a polypeptide is produced using recombinant techniques, the polypeptide may be produced as an intracellular protein or as an secreted protein, using any suitable construct and any suitable host cell, which can be a prokaryotic or eukaryotic cell, such as a bacterial (e.g., *Escherichia coli*) cell or a yeast host cell, respectively. Other examples of eukaryotic cells that may be used as host cells include insect cells, mammalian cells, filamentous fungi, and plant cells. Suitable yeast cells include, e.g., *Saccharomyces cerevisiae* and *Pichia* (e.g., *Pichia pastoris*).

Suitable mammalian cells include human cell lines, non-human primate cell lines, rodent (e.g., mouse, rat) cell lines, and the like. Suitable mammalian cell lines include, but are not limited to, HeLa cells (e.g., American Type Culture Collection (ATCC) No. CCL-2), CHO cells (e.g., ATCC Nos. CRL9618, CCL61, CRL9096), 293 cells (e.g., ATCC No. CRL-1573), Vero cells, NIH 3T3 cells (e.g., ATCC No. CRL-1658), Huh-7 cells, BHK cells (e.g., ATCC No. CCL10), PC12 cells (ATCC No. CRL1721), COS cells, COS-7 cells (ATCC No. CRL1651), RAT1 cells, mouse L cells (ATCC No. CCLI.3), human embryonic kidney (HEK) cells (ATCC No. CRL1573), HLHepG2 cells, MRC5 cells (ATCC No. CCL-171), and the like. Where mammalian host cells are used, such host cells may include human cells (e.g., HeLa, 293, H9 and Jurkat cells); mouse cells (e.g., NIH3T3, L cells, and C127 cells); primate cells (e.g., Cos 1, Cos 7 and CV1); MRC4 cells; and hamster cells (e.g., Chinese hamster ovary (CHO) cells).

A variety of host-vector systems suitable for the expression of a polypeptide may be employed according to standard procedures known in the art. See, e.g., Sambrook et al., 1989 Current Protocols in Molecular Biology Cold Spring Harbor Press, New York; Ausubel et al. 1995 Current Protocols in Molecular Biology, Eds. Wiley and Sons; "Protein Expression: A Practical Approach" (1999) S. J. Higgins and B. D. James, eds., Oxford University Press; "Protein Expression in Mammalian Cells: Methods and Protocols (Methods in Molecular Biology)" (2012) James L. Hartley, ed., Humana Press; and "Production of Recombinant Proteins" (2005) Gerd Gellisen, ed., Wiley-VCH. Methods for introduction of nucleic acids into host cells include, for example, transformation, electroporation, conjugation, calcium phosphate methods and the like. The method for transfer can be selected so as to provide for stable expression of the introduced polypeptide-encoding nucleic acid. The polypeptide-encoding nucleic acid can be provided as an inheritable episomal element (e.g., a plasmid) or can be genomically-integrated. A variety of appropriate vectors for use in production of a peptide of interest are available commercially.

Suitable expression vectors include, but are not limited to, baculovirus vectors, bacteriophage vectors, plasmids, phagemids, cosmids, fosmids, bacterial artificial chromosomes, viral vectors (e.g. viral vectors based on vaccinia virus, poliovirus, adenovirus, adeno-associated virus, SV40, herpes simplex virus, HIV-based lentivirus vectors, murine leukemia virus (MVL)-based gamma retrovirus vectors, and the like), P1-based artificial chromosomes, yeast plasmids, yeast artificial chromosomes, and any other vectors specific for specific hosts of interest (such as E. coli, mammalian cells, insect cells, or yeast cells).

An E1 polypeptide, an E2 polypeptide, a variant E2 polypeptide, a variant E1 polypeptide, or an E1/E2 heterodimer can be produced by introducing a recombinant expression vector comprising a nucleotide sequence encoding the E1 polypeptide, E2 polypeptide, variant E2 polypeptide, variant E1 polypeptide, or E1/E2 heterodimer into an appropriate host cell, where the host cell produces the encoded E1 polypeptide, E2 polypeptide, variant E2 polypeptide, variant E1 polypeptide, or E1/E2 heterodimer. In the expression vector, a polynucleotide comprising a nucleotide sequence(s) encoding the E1 polypeptide, E2 polypeptide, variant E2 polypeptide, variant E1 polypeptide, or E1/E2 heterodimer is linked to a regulatory sequence as appropriate to obtain the desired expression properties. These regulatory sequences can include promoters, enhancers, terminators, operators, repressors, and inducers. The promoters can be regulated or constitutive. Expression vectors generally have convenient restriction sites located near the promoter sequence to provide for the insertion of nucleic acid sequences encoding a protein of interest. A selectable marker operative in the expression host cell may be present.

In some cases, the E1 polypeptide, E2 polypeptide, variant E2 polypeptide, variant E1 polypeptide, or E1/E2 heterodimer is encoded in a recombinant expression vector suitable for expression in a eukaryotic host cell (e.g., an insect cell; a yeast cell; a mammalian host cell, such as CHO cells, HeLa cells, 293 cells, MRC5 cells, etc.). In some cases, a recombinant expression vector comprises a nucleotide sequence encoding E1 and E2 polypeptides (which may be wild-type or variant) as a single polypeptide chain; the recombinant expression vector is introduced into a eukaryotic host cell to generate a genetically modified host cell. In some cases, E1 and variant E2 polypeptides are initially produced as a single polypeptide chain, which is cleaved in the endoplasmic reticulum (ER) of the genetically modified host cell to produce separate E1 and variant E2 polypeptides. The separate E1 and variant E2 polypeptides can form a heterodimer (e.g., a non-covalently linked heterodimer) in the ER. In some cases, variant E1 and E2 polypeptides are initially produced as a single polypeptide chain, which is cleaved in the ER of the genetically modified host cell to produce separate variant E1 and E2 polypeptides. The separate variant E1 and E2 polypeptides can form a heterodimer (e.g., a non-covalently linked heterodimer) in the ER The E1/E2 heterodimer can be isolated from the genetically modified host cell by, e.g., lysis using a non-ionic detergent, or using a freeze-thaw method. See, e.g., Frey et al. (2010) Vaccine 28:6367. The E1/E2 heterodimer can be purified from a cell lysate and/or cell culture medium using any of a variety of methods, including size exclusion chromatography, affinity chromatography, and the like, or combinations of such methods. In some cases, the E1/E2 heterodimer is purified from cell lysate and/or cell culture medium using Galanthus nivalis (GNA) lectin affinity chromatography. In some cases, the E1/E2 heterodimer is purified from a cell lysate. In some cases, the E1/E2 heterodimer is secreted from a cell and is purified from the cell culture medium. Suitable methods that can be used for purifying an E1/E2 heterodimer are described in, e.g., U.S. Pat. Nos. 6,121,020; 6,274,148; and Mazzocca et al. (2005) J. Biol. Chem. 280:11329. For example, in some cases, an E1/E2 heterodimer can be prepared in a method comprising cell disruption and debris removal by microfiltration, followed by purification using three subsequent chromatographic steps: lectin affinity chromatography, hydroxyapatite chromatography, and ion exchange chromatography.

Alternatively, the E1 and variant E2 polypeptides, or variant E1 and E2 polypeptides, can be encoded on separate recombinant expression vectors; and produced in a cell (e.g., the same host cell or separate host cells) as separate polypeptides.

If full-length E1 and variant E2 polypeptides are expressed in a eukaryotic host cell, the E1 and variant E2 polypeptides remain bound to the endoplasmic reticulum (ER) membrane as asialoglycoproteins. If the E1 and variant E2 polypeptides have C-terminal truncations, such that the C-terminal transmembrane regions are removed, the truncated polypeptides are secreted and can acquire complex glycans such as sialic acid. Removal of approximately amino acids 660-746 of E2, or amino acids 715-746 of E2, and removal of approximately amino acids 330-383 of E1, results in secretion of E2 and E1 from a eukaryotic host cell. If E1 and variant E2 are co-expressed in the same eukaryotic host cell as full-length polypeptides, they remain in the lumen of the ER as a heterodimer.

In some cases, an E2 polypeptide suitable for use in a variant E2 polypeptide, or suitable for use in an E1/E2 heterodimer together with a variant E1 polypeptide, lacks a transmembrane region. For example, in some cases, an E2 polypeptide suitable for use in a variant E2 polypeptide, or suitable for use in an E1/E2 heterodimer together with a variant E1 polypeptide, comprises amino acids 384-659, and lacks amino acids 660-746 of a naturally-occurring E2 polypeptide; and may be referred to as "E2 ectodomain polypeptide." For example, in some cases, an E2 polypeptide suitable for use in a variant E2 polypeptide, or suitable for use in an E1/E2 heterodimer together with a variant E1 polypeptide, comprises amino acids 384-659, lacks amino acids 660-746 of a naturally-occurring E2 polypeptide, and has a length of 276 amino acids.

In some cases, an E1 polypeptide suitable for use in a variant E1 polypeptide, or suitable for use in an E1/E2 heterodimer together with a variant E2 polypeptide, lacks a transmembrane region. For example, in some cases, an E1 polypeptide suitable for use in a variant E1 polypeptide, or suitable for use in an E1/E2 heterodimer together with a variant E2 polypeptide, comprises amino acids 191-329, and lacks amino acids 330-383 of a naturally-occurring E1 polypeptide; and may be referred to as an "E1 ectodomain polypeptide." For example, in some cases, an E1 polypeptide suitable for use in a variant E1 polypeptide, or suitable for use in an E1/E2 heterodimer together with a variant E2 polypeptide, comprises amino acids 191-329, lacks amino acids 330-383 of a naturally-occurring E1 polypeptide, and has a length of 139 amino acids.

After production in a host cell, an E1 polypeptide, an E2 polypeptide, a variant E2 polypeptide, a variant E1 polypeptide, or an E1/E2 heterodimer (e.g., as separate polypeptides or as a heterodimer) can be purified from the host cell. Methods of purification of recombinantly produced polypeptides from a host cell are known in the art and include, e.g., detergent lysis (e.g., with a non-ionic detergent) or freeze-thaw lysis, followed by one or more of size exclusion column chromatography, high performance liquid chromatography, affinity chromatography, and the like.

In some cases, an E1/E2 heterodimer of the present disclosure is produced using a method comprising: A) culturing a genetically modified eukaryotic host cell that is genetically modified with a nucleic acid (e.g., recombinant expression vector) comprising a nucleotide sequence encoding an E1/E2 polypeptide that comprises, in order from N-terminus to C-terminus: a) a signal peptide that directs the E1/E2 polypeptide to the ER following translation of the E1/E2 polypeptide; b) an HCV E1 polypeptide; c) an Ig Fc region; d) a proteolytically cleavable linker; and e) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide); B) contacting a lysate of the cultured genetically modified eukaryotic host cell with a solid support comprising an Ig Fc binding moiety, generating an immobilized heterodimer comprising the HCV E1 polypeptide and a fusion polypeptide comprising: a) the Ig Fc; b) the proteolytically cleavable linker; and c) the variant E2 polypeptide; C) contacting the immobilized heterodimer with an enzyme that cleaves the proteolytically cleavable linker, thereby releasing the heterodimer; and D) collecting the released heterodimer.

In some cases, an E1/E2 heterodimer of the present disclosure is produced using a method comprising: A) culturing a genetically modified eukaryotic host cell that is genetically modified with a nucleic acid (e.g., recombinant expression vector) comprising a nucleotide sequence encoding an E1/E2 polypeptide that comprises, in order from N-terminus to C-terminus: a) a signal peptide that directs the E1/E2 polypeptide to the ER following translation of the E1/E2 polypeptide; b) an HCV E1 polypeptide; c) an Ig Fc region; d) a proteolytically cleavable linker; and e) a variant E2 polypeptide of the present disclosure, where the variant HCV E2 polypeptide comprises: i) an HCV E2 polypeptide; and ii) a heterologous polypeptide that comprises one or more T-cell epitopes present in an HCV NS3 polypeptide; B) contacting a lysate of the cultured genetically modified eukaryotic host cell with a solid support comprising an Ig Fc binding moiety, generating an immobilized heterodimer comprising the HCV E1 polypeptide and a fusion polypeptide comprising: a) the Ig Fc; b) the proteolytically cleavable linker; and c) the variant E2 polypeptide; C) contacting the immobilized heterodimer with an enzyme that cleaves the proteolytically cleavable linker, thereby releasing the heterodimer; and D) collecting the released heterodimer.

In some cases, an E1/E2 heterodimer of the present disclosure is produced using a method comprising: A) culturing a genetically modified eukaryotic host cell that is genetically modified with a nucleic acid (e.g., recombinant expression vector) comprising a nucleotide sequence encoding an E1/E2 polypeptide that comprises, in order from N-terminus to C-terminus: a) a signal peptide that directs the E1/E2 polypeptide to the ER following translation of the E1/E2 polypeptide; b) an HCV E1 polypeptide; c) an Ig Fc region; d) a proteolytically cleavable linker comprising the amino acid sequence LEVLFQGP (SEQ ID NO:5), and having a length of from 8 amino acids to 15 amino acids; and e) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide); B) contacting a lysate of the cultured genetically modified eukaryotic host cell with a solid support comprising an Ig Fc binding moiety, generating an immobilized heterodimer comprising the HCV E1 polypeptide and a fusion polypeptide comprising: a) the Ig Fc; b) the proteolytically cleavable linker; and c) the variant E2 polypeptide; C) contacting the immobilized heterodimer with an enzyme (e.g., a rhinovirus 3C protease) that cleaves the proteolytically cleavable linker, thereby releasing the heterodimer; and D) collecting the released heterodimer.

In some cases, an E1/E2 heterodimer of the present disclosure is produced using a method comprising: A) culturing a genetically modified eukaryotic host cell that is genetically modified with a nucleic acid (e.g., recombinant expression vector) comprising a nucleotide sequence encoding an E1/E2 polypeptide that comprises, in order from N-terminus to C-terminus: a) a signal peptide that directs the E1/E2 polypeptide to the ER following translation of the E1/E2 polypeptide; b) an HCV E1 polypeptide; c) an Ig Fc region; d) a proteolytically cleavable linker comprising the amino acid sequence LEVLFQGP (SEQ ID NO:5), and having a length of from 8 amino acids to 15 amino acids; and e) a variant E2 polypeptide of the present disclosure, where the variant HCV E2 polypeptide comprises: i) an HCV E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide); B) contacting a lysate of the cultured genetically modified eukaryotic host cell with a solid support comprising an Ig Fc binding moiety, generating an immobilized heterodimer comprising the HCV E1 polypeptide and a fusion polypeptide comprising: a) the Ig Fc; b) the proteolytically cleavable linker; and c) the variant E2 polypeptide; C) contacting the immobilized heterodimer with an enzyme (e.g., a fusion polypeptide comprising a glutathione-S-transferase and a human rhinovirus 3C protease (GST-HRV3C protease)) that cleaves the proteolytically cleavable linker, thereby releasing the E1E2 heterodimer; and D) collecting the released E1E2 heterodimer. In some cases, a solution comprising the released E1E2 heterodimer is applied to glutathione immobilized on a solid support, to remove the GST-HRV3C protease. For example, a solution comprising the released heterodimer can be applied to a glutathione-Sepharose 4B column, where the GST-HRV3C binds to the glutathione-Sepharose 4B; the flow-through (unbound material) comprises the released E1E2 heterodimer. In some cases, the released E1E2 heterodimer is further subjected to hydroxyapatite chromatography. Hydroxyapatite chromatography can be carried out as described in, e.g., Mazzocca et al. (2005) *J. Biol. Chem.* 280:11329.

Suitable Ig Fc binding moieties include, but are not limited to, Protein A (Graille et al. (2000) *Proc. Natl. Acad. Sci. USA* 97:5399); Protein G (Sjibring et al. (1991) *J. Biol. Chem.* 266:399); and a Protein A/G fusion polypeptide (Eliasson et al. (1988) *J. Biol. Chem.* 263:4323).

The Ig Fc binding moiety can be immobilized onto a solid support, where the solid support can be of any of a variety of forms, e.g., a bead, a magnetic bead, a plate, and the like. The solid support can be made of any of a variety of materials, including, but not limited to, polystyrene, agarose, polyesters, polyethylene, and the like.

FIG. 5A and FIGS. 8A-8B demonstrate a purification scheme and purified proteins, respectively, for Fc-tagged E1E2 constructs. As an alternative to Fc, an affinity tag such as, e.g., polyhistidine (e.g., $(His)_6$), glutathione-S-transferase (GST), calmodulin-binding peptide (CBP), Streptavidin-binding peptide (SBP), Strep-tag II, FLAG (e.g., DYKDDDDK (SEQ ID NO:52), hemagglutinin (HA) (e.g., YPYDVPDYA (SEQ ID NO:53), c-myc T7 ((e.g., EQKLISEEDL; SEQ ID NO:54), Glu-Glu, and the like, can be used. (Wood D. 2014. *Current Opinion in Structural Biology* 26 54-61; Kimple M E et al. 2013. *Current Protocols in Protein Science* 9.9.1-9.9.23). Other suitable affinity tags include, e.g., starch-binding domain (SBD); and Flag-Acidic-Target Tag (FATT). See, e.g., Wood D. 2014. *Current Opinion in Structural Biology* 26 54-61).

One or more additional purification steps can be carried out. For example, a solution comprising the released heterodimer, produced as described above, can be subjected to size exclusion chromatography, hydroxyapatite chromatography, and the like. Hydroxyapatite chromatography can be carried out as described in, e.g., Mazzocca et al. (2005) *J. Biol. Chem.* 280:11329.

An E1/E2 heterodimer of the present disclosure can be purified such that the E1/E2 heterodimer is at least 60% pure, at least 65% pure, at least 70% pure, at least 75% pure, at least 80% pure, at least 85% pure, at least 90% pure, at least 95% pure, at least 98% pure, at least 99% pure, or greater than 99% pure.

Immunogenic Compositions

The present disclosure provides an immunogenic composition comprising an E1/E2 heterodimer of the present disclosure. The present disclosure also provides an immunogenic composition comprising a variant HCV E2 polypeptide of the present disclosure. The present disclosure also provides an immunogenic composition comprising a variant HCV E1 polypeptide of the present disclosure.

E1/E2 Heterodimers Comprising an HCV E1 Polypeptide and a Variant E2 Polypeptide In some cases, an immunogenic composition of the present disclosure includes an E1/E2 heterodimer of the present disclosure, the E1/E2 heterodimer comprising an HCV E1 polypeptide and a variant E2 polypeptide of the present disclosure. The E1 polypeptide and variant E2 polypeptide present in a subject immunogenic composition may be present in the composition as a covalently or non-covalently linked heterodimer. The E1 and variant E2 polypeptides can be present in the composition as a single polypeptide chain, or can be present as two separate polypeptide chains (which may or may not be covalently linked via a disulfide bond).

The E1 and variant E2 polypeptides are isolated, and can be purified. In some cases, a subject immunogenic composition comprises E1 and variant E2 polypeptides, where the polypeptides (or mixtures of E1 and variant E2 polypeptides) are at least 60% pure, at least 65% pure, at least 70% pure, at least 75% pure, at least 80% pure, at least 85% pure, at least 90% pure, at least 95% pure, at least 98% pure, at least 99% pure, or greater than 99% pure. In some embodiments, a subject immunogenic composition does not include any other polypeptides (e.g. no other HCV polypeptides) other than HCV E1 and variant HCV E2 polypeptides.

In some cases, where an immunogenic composition of the present disclosure includes an HCV E1 polypeptide and a variant E2 polypeptide of the present disclosure, the ratio of variant E2 polypeptide to HCV E1 polypeptide is in a range of from about 2:1 to 1:1, e.g., from about 2:1 to 1.5:1, or from 1.5:1 to 1:1. In some cases, where an immunogenic composition of the present disclosure includes an HCV E1 polypeptide and a variant E2 polypeptide of the present disclosure, the molar ratio of variant E2 polypeptide to HCV E1 polypeptide is in a range of from about 1:1 to 1.5:1, from 1.5:1 to 2:1, from 2:1 to 3:1, from 3:1 to 4:1, from 4:1 to 6:1, or from 6:1 to 8:1.

An immunogenic composition of the present disclosure can comprise:

1) an E1/E2 heterodimer comprising: a) a variant E2 polypeptide of the present disclosure, where the variant HCV E2 polypeptide comprises: i) an HCV genotype 1 E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 1 E1 polypeptide;

2) an E1/E2 heterodimer comprising: a) a variant E2 polypeptide of the present disclosure, where the variant HCV E2 polypeptide comprises: i) an HCV genotype 1 E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 2 E1 polypeptide;

3) an E1/E2 heterodimer comprising: a) a variant E2 polypeptide of the present disclosure, where the variant HCV E2 polypeptide comprises: i) an HCV genotype 1 E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 3 E1 polypeptide;

4) an E1/E2 heterodimer comprising: a) a variant E2 polypeptide of the present disclosure, where the variant HCV E2 polypeptide comprises: i) an HCV genotype 2 E2 polypeptide; and ii) a heterologous polypeptide that comprises one or more T-cell epitopes ( an HCV E2 polypeptide; e.g., one or more T-cell epitopes present in an HCV NS3 polypeptide), as described above; and b) an HCV genotype 2A E1 polypeptide; and C) the third E1/E2 heterodimer comprises: a) a variant E2 polypeptide of the present disclosure, where the variant HCV E2 polypeptide comprises: i) an HCV genotype 3A E2 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3

HCV E1 polypeptide comprises: i) an HCV genotype 1 E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 3 E2 polypeptide;

4) an E1/E2 heterodimer comprising: a) a variant E1 polypeptide of the present disclosure, where the variant HCV E1 polypeptide comprises: i) an HCV genotype 2 E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 1 E2 polypeptide;

5) an E1/E2 heterodimer comprising: a) a variant E1 polypeptide of the present disclosure, where the variant HCV E1 polypeptide comprises: i) an HCV genotype 2 E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 2 E2 polypeptide;

6) an E1/E2 heterodimer comprising: a) a variant E1 polypeptide of the present disclosure, where the variant HCV E1 polypeptide comprises: i) an HCV genotype 2 E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 3 E2 polypeptide;

7) an E1/E2 heterodimer comprising: a) a variant E1 polypeptide of the present disclosure, where the variant HCV E1 polypeptide comprises: i) an HCV genotype 3 E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 1 E2 polypeptide;

8) an E1/E2 heterodimer comprising: a) a variant E1 polypeptide of the present disclosure, where the variant HCV E1 polypeptide comprises: i) an HCV genotype 3 E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 2 E2 polypeptide; or 9) an E1/E2 heterodimer comprising: a) a variant E1 polypeptide of the present disclosure, where the variant HCV E1 polypeptide comprises: i) an HCV genotype 3 E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 3 E2 polypeptide.

An immunogenic composition of the present disclosure can comprise:

1) a first E1/E2 heterodimer and a second E1/E2 heterodimer, where: A) the first E1/E2 heterodimer comprises: a) a variant E1 polypeptide of the present disclosure, where the variant HCV E1 polypeptide comprises: i) an HCV genotype 1A E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 1A E2 polypeptide; and B) the second E1/E2 heterodimer comprises: a) a variant E1 polypeptide of the present disclosure, where the variant HCV E1 polypeptide comprises: i) an HCV genotype 2A E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 2A E2 polypeptide;

2) a first E1/E2 heterodimer and a second E1/E2 heterodimer, where: A) the first E1/E2 heterodimer comprises: a) a variant E1 polypeptide of the present disclosure, where the variant HCV E1 polypeptide comprises: i) an HCV genotype 1A E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 1A E2 polypeptide; and B) the second E1/E2 heterodimer comprises: a) a variant E1 polypeptide of the present disclosure, where the variant HCV E1 polypeptide comprises: i) an HCV genotype 3A E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 3A E2 polypeptide; or 3) a first E1/E2 heterodimer and a second E1/E2 heterodimer, where: A) the first E1/E2 heterodimer comprises: a) a variant E1 polypeptide of the present disclosure, where the variant HCV E1 polypeptide comprises: i) an HCV genotype 2A E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 2A E2 polypeptide; and B) the second E1/E2 heterodimer comprises: a) a variant E1 polypeptide of the present disclosure, where the variant HCV E1 polypeptide comprises: i) an HCV genotype 3A E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 3A E2 polypeptide.

An immunogenic composition of the present disclosure can comprise:

1) a first E1/E2 heterodimer, a second E1/E2 heterodimer, and a third E1/E2 heterodimer where: A) the first E1/E2 heterodimer comprises: a) a variant E1 polypeptide of the present disclosure, where the variant HCV E1 polypeptide comprises: i) an HCV genotype 1A E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 1A E2 polypeptide; B) the second E1/E2 heterodimer comprises: a) a variant E1 polypeptide of the present disclosure, where the variant HCV E1 polypeptide comprises: i) an HCV genotype 2A E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 2A E2 polypeptide; and C) the third E1/E2 heterodimer comprises: a) a variant E1 polypeptide of the present disclosure, where the variant HCV E1 polypeptide comprises: i) an HCV genotype 3A E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 3A E2 polypeptide;

2) a first E1/E2 heterodimer, a second E1/E2 heterodimer, and a third E1/E2 heterodimer where: A) the first E1/E2 heterodimer comprises: a) a variant E1 polypeptide of the present disclosure, where the variant HCV E1 polypeptide comprises: i) an HCV genotype 1A E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 1A E2 polypeptide; B) the second E1/E2 heterodimer comprises: a) a variant E1 polypeptide of the present disclosure, where the variant HCV E1 polypeptide comprises: i) an HCV genotype 2A E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 2A E2 polypeptide; and C) the third E1/E2 heterodimer comprises: a) a variant E1 polypeptide of the present disclosure, where the variant HCV E1 polypeptide comprises: i) an HCV genotype 7A E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 7A E2 polypeptide; or 3) a first E1/E2 heterodimer, a second E1/E2 heterodimer, and a third E1/E2 heterodimer where: A) the first E1/E2 heterodimer comprises: a) a variant E1 polypeptide of the present disclosure, where the variant HCV E1 polypeptide comprises: i) an HCV genotype 1A E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 1A E2 polypeptide; B) the second E1/E2 heterodimer comprises: a) a variant E1 polypeptide of the present disclosure, where the variant HCV E1 polypeptide comprises: i) an HCV genotype 3A E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 3A E2 polypeptide; and C) the third E1/E2 heterodimer comprises: a) a variant E1 polypeptide of the present disclosure, where the variant HCV E1 polypeptide comprises: i) an HCV genotype 7A E1 polypeptide; and ii) a heterologous polypeptide that comprises one or more T-cell epitopes (e.g., one or more T cell epitopes present in an HCV polypeptide other than an HCV E1 polypeptide or an HCV E2 polypeptide; e.g., one or more T-cell epitopes present in an HCV NS3 polypeptide), as described above; and b) an HCV genotype 7A E2 polypeptide.

Other combinations of E1/E2 heterodimers are also possible.

Formulations

HCV E1 polypeptides, HCV E2 polypeptides, variant E2 polypeptides, variant E1 polypeptides, and E1/E2 heterodimers can be formulated with a pharmaceutically acceptable excipient(s) to generate a subject immunogenic composition. A wide variety of pharmaceutically acceptable excipients is known in the art and need not be discussed in detail herein. Pharmaceutically acceptable excipients have been amply described in a variety of publications, including, for example, A. Gennaro (2000) "Remington: The Science and Practice of Pharmacy", 20th edition, Lippincott, Williams, & Wilkins; Pharmaceutical Dosage Forms and Drug Delivery Systems (1999) H. C. Ansel et al., eds 7th ed., Lippincott, Williams, & Wilkins; and Handbook of Pharmaceutical Excipients (2000) A. H. Kibbe et al., eds., 3rd ed. Amer. Pharmaceutical Assoc.

In some embodiments, the E1 polypeptides, E2 polypeptides, variant E2 polypeptides, variant E1 polypeptides, or E1/E2 heterodimers are formulated in an aqueous buffer. Suitable aqueous buffers include, but are not limited to, acetate, succinate, citrate, and phosphate buffers varying in strengths from about 5 mM to about 100 mM. In some embodiments, the aqueous buffer includes reagents that provide for an isotonic solution. Such reagents include, but are not limited to, sodium chloride; and sugars e.g., mannitol, dextrose, sucrose, and the like. In some embodiments, the aqueous buffer further includes a non-ionic surfactant such as polysorbate 20 (TWEEN®20) or polysorbate 80 (TWEEN®80). For example, a formulation of E1 and variant E2 polypeptides in an aqueous buffer can include, e.g., from about 0.01% to about 0.05% polysorbate-20 (TWEEN®20) non-ionic detergent. Optionally the formulations may further include a preservative. Suitable preservatives include, but are not limited to, a benzyl alcohol, phenol, chlorobutanol, benzalkonium chloride, and the like. In many cases, the formulation is stored at about 4° C. Formulations may also be lyophilized, in which case they generally include cryoprotectants such as sucrose, trehalose, lactose, maltose, mannitol, and the like. Lyophilized formulations can be stored over extended periods of time, even at ambient temperatures. In some cases, the aqueous buffer further includes a non-ionic surfactant. In some cases, the aqueous buffer includes the non-ionic surfactant Triton™X-100, e.g., 0.1% Triton™X-100.

E1 polypeptides, E2 polypeptides, variant E2 polypeptides, variant E1 polypeptides, and E1/E2 heterodimers can be formulated into preparations for injection by dissolving, suspending or emulsifying them in an aqueous or nonaqueous solvent, such as vegetable or other similar oils, synthetic aliphatic acid glycerides, esters of higher aliphatic acids or propylene glycol; and if desired, with conventional additives such as solubilizers, isotonic agents, suspending agents, emulsifying agents, stabilizers and preservatives.

An immunogenic composition of the present disclosure can include, e.g., pharmaceutical grades of mannitol, lactose, starch, magnesium stearate, sodium saccharin, talcum, cellulose, glucose, sucrose, magnesium, carbonate, and the like. The compositions may contain pharmaceutically acceptable auxiliary substances as required to approximate physiological conditions such as pH adjusting and buffering agents, toxicity adjusting agents and the like, for example, sodium acetate, sodium chloride, potassium chloride, calcium chloride, sodium lactate and the like.

The concentration of E1 polypeptides, E2 polypeptides, variant E2 polypeptides, variant E1 polypeptides, or E1/E2 heterodimers in a formulation can vary widely (e.g., from less than about 0.1% to at least about 2%, to as much as 20% to 50% or more by weight) and can be selected primarily based on fluid volumes, viscosities, and patient-based factors in accordance with the particular mode of administration selected and the patient's needs.

The HCV polypeptide-containing formulations of the present disclosure can be provided in the form of a solution, suspension, tablet, pill, capsule, powder, gel, cream, lotion, ointment, aerosol or the like. It is recognized that oral administration can require protection of the compositions from digestion. This is typically accomplished either by association of the composition with an agent that renders it resistant to acidic and enzymatic hydrolysis or by packaging the composition in an appropriately resistant carrier. Means of protecting from digestion are well known in the art.

The HCV polypeptide-containing formulations of the present disclosure can also be provided so as to enhance serum half-life of the heterodimer following administration. For example, where isolated E1 polypeptides, E2 polypeptides, variant E2 polypeptides, variant E1 polypeptides, or E1/E2 heterodimers are formulated for injection, the HCV polypeptide may be provided in a liposome formulation, prepared as a colloid, or other conventional techniques for extending serum half-life. A variety of methods are available for preparing liposomes, as described in, e.g., Szoka et al., Ann. Rev. Biophys. Bioeng. 9:467 (1980), U.S. Pat. Nos. 4,235,871, 4,501,728 and 4,837,028. The preparations may also be provided in controlled release or slow-release forms.

Adjuvant

An immunogenic composition of the present disclosure can include an adjuvant. Examples of known suitable adjuvants that can be used in humans include, but are not necessarily limited to, alum, aluminum phosphate, aluminum hydroxide, MF59 (4.3% w/v squalene, 0.5% w/v Tween 80™, 0.5% w/v Span 85), CpG-containing nucleic acid (where the cytosine is unmethylated), QS21, MPL, 3DMPL, extracts from Aquilla, ISCOMS, LT/CT mutants, poly(D,L-lactide-co-glycolide) (PLG) microparticles, Quil A, interleukins, and the like. For experimental animals, one can use Freund's, N-acetyl-muramyl-L-threonyl-D-isoglutamine (thr-MDP), N-acetyl-nor-muramyl-L-alanyl-D-isoglutamine (CGP 11637, referred to as nor-MDP), N-acetylmuramyl-L-alanyl-D-isoglutaminyl-L-alanine-2-(1'-2'-dipalmitoyl-sn-glycero-3-hydroxyphosphoryloxy)-ethylamine (CGP 19835A, referred to as MTP-PE), and RIBI, which contains three components extracted from bacteria, monophosphoryl lipid A, trehalose dimycolate and cell wall skeleton (MPL+TDM+CWS) in a 2% squalene/Tween 80 emulsion. The effectiveness of an adjuvant may be determined by one or more of measuring the amount of antibodies directed against the immunogenic antigen or antigenic epitope thereof, measuring a cytotoxic T lymphocyte response to the antigen, and measuring a helper T cell response to the antigen.

Further exemplary adjuvants to enhance effectiveness of the composition include, but are not limited to: (1) oil-in-water emulsion formulations (with or without other specific immunostimulating agents such as muramyl peptides (see below) or bacterial cell wall components), such as for example (a) MF59TM (see, e.g., WO 90/14837), containing 5% Squalene, 0.5% Tween 80, and 0.5% Span 85 (optionally containing MTP-PE) formulated into submicron particles using a microfluidizer, (b) SAF, containing 10% Squalane, 0.4% Tween 80, 5% pluronic-blocked polymer L121, and thr-MDP either microfluidized into a submicron emulsion or vortexed to generate a larger particle size emulsion, and (c) RIBI™ adjuvant system (RAS), (Ribi Immunochem, Hamilton, Mont.) containing 2% Squalene, 0.2% Tween 80, and one or more bacterial cell wall components such as monophosphorylipid A (MPL), trehalose dimycolate (TDM), and cell wall skeleton (CWS), e.g., MPL+CWS (Detox™); (2) saponin adjuvants, such as QS21 or Stimulon™ (Cambridge Bioscience, Worcester, Mass.) may be used or particles generated therefrom such as ISCOMs (immunostimulating complexes), which ISCOMS may be devoid of additional detergent e.g. WO 00/07621; (3) Complete Freund's Adjuvant (CFA) and Incomplete Freund's Adjuvant (IFA); (4) cytokines, such as interleukins (e.g. IL-1, IL-2, IL-4, IL-5, IL-6, IL-7, IL-12 (WO99/44636), etc.), interferons (e.g. gamma interferon), macrophage colony stimulating factor (M-CSF), tumor necrosis factor (TNF), etc.; (5) monophosphoryl lipid A (MPL) or 3-O-deacylated MPL (3dMPL) e.g. GB-2220221, EP-A-0689454, optionally in the substantial absence of alum when used with pneumococcal saccharides e.g. WO 00/56358; (6) combinations of 3dMPL with, for example, QS21 and/or oil-in-water emulsions (see, e.g. EP-A-0835318, EP-A-0735898, EP-A-0761231); (7) oligonucleotides comprising a CpG motif containing at least one CG dinucleotide, where the cytosine is unmethylated (see, e.g., WO 96/02555, WO 98/16247, WO 98/18810, WO 98/40100, WO 98/55495, WO 98/37919 and WO 98/52581); (8) a polyoxyethylene ether or a polyoxyethylene ester (see, e.g. WO 99/52549); (9) a polyoxyethylene sorbitan ester surfactant in combination with an octoxynol (WO 01/21207) or a polyoxyethylene alkyl ether or ester surfactant in combination with at least one additional non-ionic surfactant such as an octoxynol (WO 01/21152); (10) a saponin and an immunostimulatory oligonucleotide (e.g. a CpG oligonucleotide) (WO 00/62800); (11) an immunostimulant and a particle of metal salt (see, e.g. WO 00/23105); (12) a saponin and an oil-in-water emulsion (see e.g. WO 99/11241); (13) a saponin (e.g. QS21)+3dMPL+IM2 (optionally including a sterol) (see, e.g. WO 98/57659); (14) other substances that act as immunostimulating agents to enhance the efficacy of the composition. Muramyl peptides include N-acetyl-muramyl-L-threonyl-D-isoglutamine (thr-MDP), N-25 acetyl-normuramyl-L-alanyl-D-isoglutamine (nor-MDP), N-acetylmuramyl-L-alanyl-D-isoglutarninyl-L-alanine-2-(1'-2'-dipalmitoyl-sn-glycero-3-hydroxyphosphoryloxy)-ethylamine MTP-PE), etc. Also suitable for use is Matrix-M™; Matrix-M™ is an adjuvant that comprises 40 nm nanoparticles comprising Quillaja saponins, cholesterol, and phospholipid. Adjuvants suitable for administration to a human are of particular interest. In some cases, the adjuvant is one that enhances a CD4+ T helper response to the immunogen.

In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is keyhole limpet hemocyanin.

Methods of Inducing an Immune Response to HCV

The present disclosure provides a method of inducing an immune response (e.g., a protective immune response) to at least one HCV genotype in a mammalian subject. In some cases, the methods comprise administering to an individual in need thereof an effective amount of a heterodimeric polypeptide of the present disclosure, or a composition (e.g., an immunogenic composition) comprising a heterodimeric polypeptide of the present disclosure. In other cases, the methods comprise administering to an individual in need thereof an effective amount of a nucleic acid(s) (e.g., a recombinant expression vector) comprising nucleotide sequences encoding a heterodimeric polypeptide of the present disclosure.

An HCV immunogenic composition of the present disclosure, or a nucleic acid(s) comprising nucleotide sequences encoding a heterodimeric polypeptide of the present disclosure, is generally administered to a human subject who has an HCV infection or who is at risk of acquiring an HCV infection (e.g., is at greater risk than the general population of acquiring an HCV infection) so as to prevent or at least partially arrest the development of disease and its complications. An amount adequate to accomplish this is defined as a "therapeutically effective dose" or a "therapeutically effective amount." "Prophylactic" use of a subject immunogenic composition generally refers to administration to an individual who has not been infected with HCV. "Therapeutic" use of a subject immunogenic composition can refer to "prophylactic" use (administration to an individual who has not been infected with HCV) and/or to administration to an individual who has an HCV infection. A "therapeutically effective amount" of an immunogenic composition of the present disclosure, can be an amount that, when administered in one or more doses to an individual who is not infected with HCV, is effective to induce an immune response in the individual to HCV. A "therapeutically effective amount" of an immunogenic composition of the present disclosure, can be an amount that, when administered in one or more doses to an individual who is infected with HCV, is effective to enhance an immune response in the individual to HCV.

Amounts effective for therapeutic use will depend on, e.g., the immunogenic composition or the nucleic acid(s) comprising nucleotide sequences encoding a heterodimeric polypeptide of the present disclosure, the manner of administration, the weight and general state of health of the patient, and the judgment of the prescribing physician. Single or multiple doses of a subject immunogenic composition, or a nucleic acid(s) comprising nucleotide sequences encoding a heterodimeric polypeptide of the present disclosure, can be administered depending on the dosage and frequency required and tolerated by the patient, and route of administration.

In some cases, an effective amount (e.g., a therapeutically effective amount) of an HCV E1/E2 immunogenic composition of the present disclosure, or a nucleic acid(s) comprising nucleotide sequences encoding a heterodimeric polypeptide of the present disclosure, is an amount that, when administered to an individual in one or more doses, is effective to induce an antibody response (e.g., a neutralizing antibody response) to HCV in the individual. For example, antibody to HCV (e.g., extracellular HCV), and/or to an HCV-infected cell, can be induced.

An effective amount of an HCV E1/E2 immunogenic composition of the present disclosure, or a nucleic acid(s) comprising nucleotide sequences encoding a heterodimeric polypeptide of the present disclosure, can be an amount that, when administered to an individual in one or more doses, is effective to induce a neutralizing antibody response to HCV of a variety of genotypes (e.g., genotype 1; genotype 3; etc.). A neutralizing antibody response reduces binding of HCV to one or more host receptors for HCV and inhibits entry of HCV into a cell.

In some cases, an effective amount (e.g., a therapeutically effective amount) of an HCV E1/E2 immunogenic composition of the present disclosure, or a nucleic acid(s) comprising nucleotide sequences encoding a heterodimeric polypeptide of the present disclosure, is an amount that, when administered to an individual in one or more doses, is effective to induce a cytotoxic T lymphocyte (CTL) response to HCV. For example, a CTL response to an HCV-infected cell can be induced.

In some cases, an effective amount (e.g., a therapeutically effective amount) of an HCV E1/E2 immunogenic composition of the present disclosure, or a nucleic acid(s) comprising nucleotide sequences encoding a heterodimeric polypeptide of the present disclosure, is an amount that, when administered to an individual in one or more doses, is effective to induce a helper T lymphocyte (e.g., $CD4^+$ T cell) to HCV in an individual.

In some cases, an effective amount (e.g., a therapeutically effective amount) of an HCV E1/E2 immunogenic composition of the present disclosure, or a nucleic acid(s) comprising nucleotide sequences encoding a heterodimeric polypeptide of the present disclosure, is an amount that, when administered to an individual in one or more doses, is effective to induce an antibody response (e.g., a neutralizing antibody response) and/or a CTL response and/or a helper T cell response to HCV genotype 1. In some cases, an effective amount (e.g., a therapeutically effective amount) of an HCV E1/E2 immunogenic composition of the present disclosure, or a nucleic acid(s) comprising nucleotide sequences encoding a heterodimeric polypeptide of the present disclosure, is an amount that, when administered to an individual in one or more doses, is effective to induce an antibody response (e.g., a neutralizing antibody response) and/or a CTL response and/or a helper T cell response to HCV genotype 3. In some cases, an effective amount (e.g., a therapeutically effective amount) of an HCV E1/E2 immunogenic composition of the present disclosure, or a nucleic acid(s) comprising nucleotide sequences encoding a heterodimeric polypeptide of the present disclosure, is an amount that, when administered to an individual in one or more doses, is effective to induce an antibody response (e.g., a neutralizing antibody response) and/or a CTL response and/or a helper T cell response to HCV genotype 1 and HCV genotype 3. In some cases, an effective amount (e.g., a therapeutically effective amount) of an HCV E1/E2 immunogenic composition of the present disclosure, or a nucleic acid(s) comprising nucleotide sequences encoding a heterodimeric polypeptide of the present disclosure, is an amount that, when administered to an individual in one or more doses, is effective to induce an antibody response (e.g., a neutralizing antibody response) and/or a CTL response and/or a helper T cell response to HCV of any genotype.

An HCV E1/E2 immunogenic composition of the present disclosure, or a nucleic acid(s) comprising nucleotide sequences encoding a heterodimeric polypeptide of the present disclosure, is generally administered in an amount effective to elicit an immune response, e.g., a humoral immune response (e.g., an antibody response) and/or a CTL response, in the mammalian subject. Effective amounts for immunization will vary, and can generally range from about 1 µg to 100 µg per 70 kg patient, e.g., from about 5 µg/70 kg to about 50 µg/70 kg. Substantially higher dosages (e.g. 10 mg to 100 mg or more) may be suitable in oral, nasal, or topical administration routes. The initial administration can be followed by booster immunization of the same HCV E1/E2 immunogenic composition or a different HCV E1/E2 immunogenic composition. In some instances, a subject method of inducing an immune response involves an initial administration of an HCV E1/E2 immunogenic composition of the present disclosure, followed by at least one booster, and in some instances involves two or more (e.g., three, four, or five) boosters. The interval between an initial administration and a booster, or between a give booster and a subsequent booster, can be from about 1 week to about 12 weeks, e.g., from about 1 week to about 2 weeks, from about 2 weeks to about 4 weeks, from about 4 weeks to about 6 weeks, from about 6 weeks to about 8 weeks, from about 8 weeks to about 10 weeks, or from about 10 weeks to about 12 weeks.

In general, immunization can be accomplished by administration of an HCV E1/E2 immunogenic composition of the present disclosure, or a nucleic acid(s) comprising nucleotide sequences encoding a heterodimeric polypeptide of the present disclosure, by any suitable route, including administration of the composition orally, nasally, nasopharyngeally, parenterally, enterically, gastrically, topically, transdermally, subcutaneously, intramuscularly, in tablet, solid, powdered, liquid, aerosol form, locally or systemically, with or without added excipients. Actual methods for preparing parenterally administrable compositions will be known or apparent to those skilled in the art and are described in more detail in such publications as Remington's Pharmaceutical Science, 15th ed., Mack Publishing Company, Easton, Pa. (1980). In some instances, immunization is accomplished by intramuscular injection of an HCV E1/E2 immunogenic composition of the present disclosure.

In some cases, a method of the present disclosure for inducing an immune response to HCV in an individual comprises administering to the individual an effective amount of a nucleic acid(s) comprising nucleotide sequences encoding a heterodimeric polypeptide of the present disclosure. In some cases, the nucleic acid is present in an expression vector. Suitable expression vectors include, but are not limited to, a replication-defective adenovirus vector; a replication-defective vaccinia virus vector; a lentivirus vector (e.g., a self-inactivating lentivirus vector); a retroviral vector (e.g., a self-inactivating retroviral vector); an adeno-associated virus vector; and the like. In some cases, the vector is a modified vaccinia Ankara (MVA) vector, or an MVA-based vector (see, e.g., Verheust et al. (2012) *Vaccine* 30:2623).

In some cases, a method of the present disclosure for inducing an immune response to HCV in an individual comprises administering to the individual an effective amount of a nucleic acid(s) comprising nucleotide sequences encoding a heterodimeric polypeptide of the present disclosure. In some cases, the nucleic acid is an RNA comprising nucleotide sequences encoding a heterodimeric polypeptide of the present disclosure. See, e.g., Weiner (2013) *Molec. Therapy* 21:506; and Ulmer et al. (2012) *Vaccine* 30:4414. In some cases, an RNA (e.g., a single mRNA molecule; or 2 mRNA molecules) comprising nucleotide sequences encoding a heterodimeric polypeptide of the present disclosure is formulated with a liposome. In some cases, an RNA (e.g., a single mRNA molecule; or 2 mRNA molecules) comprising nucleotide sequences encoding a heterodimeric polypeptide of the present disclosure is complexed with protamine. In some cases, an RNA (e.g., a single mRNA molecule; or 2 mRNA molecules) comprising nucleotide sequences encoding a heterodimeric polypeptide of the present disclosure is complexed with 1,2-dioleoyl-3-trimethylammonium-propane/1,2-dioleoyl-sn-glycero-3-phosphoethanolamine (DOTAP/DOPE).

Individuals Suitable for Administration

Individuals who are suitable for administration with an HCV composition of the present disclosure include immunologically naïve individuals (e.g., individuals who have not been infected with HCV and/or who have not been administered with an HCV vaccine).

Individuals who are suitable for administration with an HCV composition of the present disclosure include individuals who are at greater risk than the general population of becoming infected with HCV, where such individuals include, e.g., intravenous drug users; individuals who are the recipients, or the prospective recipients, of blood or blood products from another (donor) individual(s); individuals who are the recipients, or the prospective recipients, of non-autologous cells, tissues, or organs from another (donor) individual; health care workers; emergency medical and non-medical personnel (e.g., first responders; fire fighters; emergency medical team personnel; etc.) and the like.

Individuals who are suitable for administration with an HCV composition of the present disclosure include individuals who recently became exposed to HCV or who recently became infected with HCV. For example, a subject immunogenic composition can be administered to an individual within from about 24 hours to about 48 hours, from about 48 hours to about 1 week, or from about 1 week to about 4 weeks, following possible or suspected exposure to HCV or following infection with HCV.

Individuals who are suitable for administration with an HCV composition of the present disclosure include individuals who have been diagnosed as having an HCV infection, and include chronically infected individuals. In some cases, an individual who has been diagnosed as having an HCV infection is treated with an anti-viral agent and a subject HCV immunogenic composition. Suitable anti-viral agents for treating HCV infection include, e.g., ribavirin (1-β-D-ribofuranosyl-1H-1,2,4-triazole-3-carboxamide); interferon-alpha (IFN-α) (where "IFN-α" includes IFN-α2a; IFN-α2b; IFN-α that is conjugated with poly(ethylene glycol) ("pegylated IFN-α), where the pegylated IFN-α can be pegylated IFN-α2a or pegylated IFN-α 2b); an HCV NS3 protease inhibitor (e.g., boceprevir; telaprevir); and an HCV NS5 protease inhibitor. In some cases, an individual who has been diagnosed as having an HCV infection is treated with, e.g.: 1) IFN-α+ribavirin; and a subject HCV immunogenic composition; or 2) IFN-α+ribavirin+an HCV protease inhibitor (e.g., boceprevir or telaprevir); and a subject HCV immunogenic composition. Suitable anti-viral agents for treating HCV infection include Sovaldi (Sofosbuvir; a nucleotide analog that functions as an NS5B polymerase inhibitor), alone or in combination with pegylated IFN-α and ribavirin.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); pl, picoliter(s); s or sec, second(s); min, minute(s); h or hr, hour(s); aa, amino acid(s); kb, kilobase(s); bp, base pair(s); nt, nucleotide(s); i.m., intramuscular(ly); i.p., intraperitoneal (ly); s.c., subcutaneous(ly); and the like.

Example 1

Identification of T-Cell Epitopes in HCV NS3

Consensus sequences for various HCV genotypes were built using Geneious software. This included consensus sequences for genotype HCV1a, 1b, 2a, 2b, 3, 4, 5, and 6 from 224, 357, 20, 27, 30, 18, 3, and 59 different isolates, respectively. For genotype HCV7, the only reported isolate was used in the alignment.

To identify CD4 T cell epitopes, all the reported CD4+ T cell epitopes through Jul. 12, 2013 were extracted from the Immune Epitope Database and Analysis Resource (IDEB). The sequence of each epitope was entered into an alignment, including sequences from HCV genotypes 1a, 1b, 2a, 2b, and 3, as these are common HCV genotypes around the world. More than 287 epitopes that were reported in 518 studies as MHC II-restricted CD4 T cells epitopes with positive response in humans for HCV were extracted. Of those, which were grouped in 159 clusters at 70% identity, 217 were located and annotated on the sequences of HCV genotypes of 1a, 1b, 2a, 2b, and 3. In the case of mismatch of 1-3 amino acids in the sequence of the epitope against the HCV sequences, the epitope was still included in the analysis. The excluded 70 epitopes consisted of those that were located on structural regions of HCV polyprotein (core, E1, E2, and P7), were repeats of other epitopes, or were not found on the sequence. After addition of all epitopes, it appeared that almost the whole non-structural region of HCV polyprotein from residue number 941 (based on the HCV1a sequence), in the middle of non-structural protein 2 (NS2), to the residue number 3000, close to the end of NS5b were heavily covered by epitopes with exception of the regions 1980-2081 (the beginning of NS5a) and 2710-2788 (in the middle of NS5b).

Two additional analyses were performed: first, a Conservancy Analysis for all 217 epitopes was performed using IDEB software. In one analysis, all epitopes were checked for conservation amongst all 9 HCV genotypes (HCV1a, 1b, 2a, 2b, 3, 4, 5, 6, and 7), which resulted in 6 conserved epitopes and in the second analysis, the same list of 217 epitopes were evaluated against genotypes 1a, 1b, and 3 that resulted in 16 conserved epitopes. The partially overlapped epitopes were combined and of the completely overlapped epitopes, the largest one was retained. This resulted in a total of 11 so called "Region" that were conserved among all 3 genotypes of HCV1a, 1b, and 3. Of these 11, 4 were conserved among 9 HCV genotypes (HCV1a, 1b, 2a, 2b, 3, 4, 5, 6, and 7) and the rest were conserved among 4 to 8 genotypes (Table 1; FIG. 10).

Similar to CD4 epitopes, all reported CD8 T cell epitopes through Jul. 12, 2013 were extracted from the Immune Epitope Database and Analysis Resource (IDEB). A total number of 413 epitopes in 216 clusters at 70% from 1226 studies were found; however, to narrow down the list, an alternative search performed based on the common HLA class-I Alleles in North America. According to the latest demographic statistics from 2013, the population of USA as the representative of the North America comprises of different ethnic groups including White (64%), Black (12%), Hispanic (16%), Asian or Pacific Islanders (5%), and others including Natives, Alaskans, and etc. (3%). The first 30 common MHC-I alleles (frequency>~6-7%) for each of the first four common populations in USA were used in a search for any HCV epitopes that were reported for any of these individual alleles, which comprised of A*01:01, A*02:03, A*02:06, A*02:07, A*03:01, A*11:01, A*23:01, A*24:02, A*25:01, A*26:01, A*29:02, A*30:01, A*30:02, A*31:01, A*32:01, A*33:03, A*34:02, A*68:01, A*68:02, A*74:01, B*07:02, B*08:01, B*14:02, B*15:01, B*15:02, B*15:03, B*18:01, B*35:01, B*38:02, B*40:01, B*40:02, B*42:01, B*44:01, B*44:03, B*45:01, B*46:01, B*49:01, B*51:01, B*52:01, B*53:01, B*54:01, B*55:02, B*57:01, B*58:01, C*01:02, C*02:02, C*03:03, C*03:04, C*04:01, C*05:01, C*06:02, C*07:01, C*07:02, C*08:01, C*08:02, C*14:02, and C*16:01.

Using IDEB database through Jul. 12, 2013, a total of 106 MHC-I CD8 T cell epitopes that were restricted to each of the afore-mentioned alleles were found as described in Table 2 (FIG. 11) with their specific anchor positions. The sequence of each epitope was searched and entered in an alignment including sequences from HCV genotypes 1a, 1b, and 3 as the genotypes of interest for a vaccine that will be potentially used in North America. Of 106 epitopes, 64 were located and annotated on the sequences of HCV genotypes of 1a, 1b, and 3. In the case of mismatch of 1-3 amino acids in the sequence of the epitope against the HCV sequences, the epitope was still included in the analysis. The excluded 42 epitopes consisted of those that were located on structural regions of HCV polyprotein (core, E1, E2, and P7), were repeats of other epitopes, or were not found on the sequence.

A Conservancy Analysis for all 106 epitopes was performed using IDEB software. In one analysis, all epitopes were checked for conservancy against nine HCV genotypes (1a, 1b, 2a, 2b, 3, 4, 5, 6, and 7) resulted in 2 conserved epitopes and in the second analysis the same list of epitopes were evaluated against genotypes 1a, 1b, and 3 that resulted in 6 conserved epitopes. The partially overlapped epitopes were combined and of the completely overlapped epitopes, the largest one was retained. This resulted in a total of 5 conserved epitopes or combination of epitopes (called Regions) with all to be conserved among 3 genotypes and 2 to be conserved among all 9 HCV genotypes. The list of these regions (CD8-R1 to CD8-R5) is described in Table 3 (FIG. 12).

In addition, a Conservancy Analysis for all 413 CD8 epitopes was done using IDEB software. When checked for conservancy against nine HCV genotypes (1a, 1b, 2a, 2b, 3, 4, 5, 6, and 7), 2 new conserved epitopes were found and in the second analysis the same list of epitopes were evaluated against genotypes 1a, 1b, and 3 that resulted in 7 new conserved epitopes. The partially overlapped epitopes were combined and of the completely overlapped epitopes, the largest one was retained. This resulted in a total of 5 new conserved epitopes or combination of epitopes (called Regions) with all to be conserved among 3 genotypes and 1 to be conserved among all 9 HCV genotypes. The list of these regions (CD8-R5 to CD8-R10) is described in Table 3 (FIG. 12).

According to the Immunodominancy Analysis (IDEB) and the relative location of conserved epitopes, as well to use a minimal sequence with which to extend the C-terminus of gpE2, 5 antigens were chosen based on CD4 epitopes and 4 antigens based on CD8 epitopes (Table 4; FIGS. 13A-13D) to be used for extension of gpE2. For each selected antigen (Ag), the number of CD4 and CD8 regions that are included is described (Table 4; FIGS. 13A-13D).

The CD8-based antigens were longer, so as to include more CD8 epitopes from different HLAs. The focus was on CD4-based antigens (CD4-Ag-1 to CD4-Ag-5) that also include CD8 epitopes; accordingly, 4 antigens Table 5; FIG. 14) were cloned to gpE1/gp/E2 sequence for expression and purification and animal studies.

Example 2

Expression of Fc-Tagged E1E2 with or without T-Cell Polytope (TPx) Extensions

As shown in the schematic diagram (FIG. 5A) the nucleotide sequence for the full-length HCV E1E2 glycoprotein was inserted downstream of the cytomegalovirus promoter (PCMV) in a mammalian cell expression vector. The E1E2 sequence is preceded by the signal peptide sequence from tissue plasminogen activator (tPA) to direct the polypeptide to the endoplasmic reticulum (ER) following translation of the polypeptide. At the N terminus of E2, a duplication of amino acids 384-385 (ET) was inserted followed by the human IgG1 Fc tag and a PreScission Protease (PP) recognition sequence (LEVLFQGP; SEQ ID NO:5). Constructs containing a T-cell polytope (TPx; x=29, 52 or 100 amino acids) have this sequence inserted downstream of the PP recognition site. After translation of the E1E2 polypeptide and entry into the ER, host-derived signal peptidase (SP) cleaves the signal sequences in the tPA signal peptide as well as the C-terminus of E1, resulting in E1 and E2 polypeptides. For purification of E1E2 heterodimers, PreScission Protease (PP) can be added to the Fc-tagged E1E2 protein (immobilized on Protein A or Protein G affinity resins) to remove the Fc tag from the N terminus of the E2 polypeptide. This strategy can be applied to HCV E1E2 glycoproteins of different genotypes (FIGS. 6A-7B and 7A-8B).

As shown in the schematic diagram (FIG. 5A) the nucleotide sequence for the full-length HCV E1E2 glycoprotein was inserted downstream of the cytomegalovirus promoter (PCMV) in a mammalian cell expression vector. The E1E2 sequence is preceded by the signal peptide sequence from tissue plasminogen activator (tPA) to direct the polypeptide to the endoplasmic reticulum (ER) following translation of the polypeptide. At the N terminus of E2, a duplication of amino acids 384-385 relative to the particular genotype (e.g.: ET addition for H77; GenBank NP_671941) was inserted followed by the human IgG1 Fc tag and a PreScission Protease (PP) recognition sequence (LEVLFQGP; SEQ ID NO:5). Constructs containing a T-cell polytope (TPx; x=29, 52 or 100 amino acids; e.g., TP29, TP52, and TP100 as set forth in FIGS. 14A-14D) have this sequence inserted downstream of the PP recognition site. After translation of the E1E2 polypeptide and entry into the ER, host-derived signal peptidase (SP) cleaves the signal sequences in the tPA signal peptide as well as the C-terminus of E1, resulting in E1 and E2 polypeptides. For purification of E1E2 heterodimers, PreScission Protease (PP) can be added to the Fc-tagged E1E2 protein (immobilized on Protein A or Protein G affinity resins) to remove the Fc tag from the N terminus of the E2 polypeptide. This strategy can be applied to HCV E1E2 glycoproteins of different genotypes (FIGS. 6A-7B and 7A-8B).

FIGS. 5A-5B. Schematic representation of Fc-tagged and untagged E1E2 expression constructs and polypeptide processing. The E1E2 polypeptide is expressed under the control of the CMV promoter ($P_{CMV}$) and includes the signal sequence from tissue plasminogen activator (tPA). Insertion sites are shown for representative HCV E1E2 sequences: H77 (GenBank NP_671941) and Alberta isolate Avi1a129 (genotype 1A), JFH1 (Genbank AB047639; genotype 2A), S52 (Genbank ADF97232.1; genotype 3a), Alberta isolate Avi3a177 (genotype 3A), and isolate QC69 (Genbank: ABN05226.1; genotype 7A). Sizes of the polypeptide regions are shown at the top (aa=amino acids). (A) Fc tagged E1E2: At the N-terminus of E2, a duplication of the E2 N-terminal amino acids respective to the particular genotype (eg: ET addition for H77; GenBank NP_671941) is inserted followed by the human IgG1 Fc tag (hu IgG1 Fc) and a PreScission Protease (PP) recognition sequence (LEVLFQGP; SEQ ID NO:5). Constructs containing a T-cell polytope (TPx; where x is, e.g., 25, 52, or 100 amino acids) have this polytope sequence inserted C-terminal of the PP recognition site. Following expression of the polypeptide, signal peptidase (SP) cleavages result in the downstream E1 and E2 polypeptides shown. The E1 and E2 polypeptides interact to form a heterodimer. For purification purposes, the Fc tagged E1E2 is immobilized on Protein A or Protein G resin and digested with PreScission Protease (PP) (cleavage between Q and G in the LEVLFQGP (SEQ ID NO:5) sequence) to release the untagged E1E2 heterodimer. (B) Untagged E1E2: At the N-terminus of E2, a duplication of the E2 N-terminal amino acids respective to the particular genotype (eg: ET addition for H77; GenBank NP_671941) is inserted followed by a T-cell polytope (TPx; where x is, e.g., 25, 52, or 100 amino acids). Following expression of the polypeptide, signal peptidase (SP) cleavages result in the downstream E1 and E2 polypeptides shown. The E1 and E2 polypeptides interact to form a heterodimer. The untagged E1E2 is purified using *Galanthus nivalis* lectin agarose (GNA) chromatography. The duplicated E2 N-terminal residues (shown: ET addition for H77; GenBank NP_671941) and TPx are retained in the purified E1E2.

FIGS. 6A-6B. Alignment of the Fc-tagged E1-E2 polypeptide (with or without TPx extension) for H77 and Alberta isolate Avi1a129 (genotype 1A). The amino acid sequence for the coding region of the tPa-E1-Fc-PP-TPx-E2 construct (as diagrammed in FIGS. 5A-5B) for the Alberta isolate (Avi1a129) and H77 (GenBank NP_671941) was aligned using Geneious software v5.6.4. (*) denotes the insertion of the duplicated N-terminal E2 residues that precede the Fc-PP-TPx tag (Avi1a129: QT and H77: ET).

FIGS. 7A-7B. Alignment of the Fc-tagged E1-E2 polypeptide (with or without TPx extension) for S52 (Genbank ADF97232.1) and Alberta isolate Avi3a177 (genotype 3A). The amino acid sequence for the coding region of the tPA-E1-Fc-PP-TPx-E2 construct (as diagrammed in FIGS. 5A-5B) for the Alberta isolate (Avi3a177) and S52 was aligned using Geneious software v5.6.4. (*) denotes the insertion of the duplicated N-terminal E2 residues that precede the Fc-PP-TPx tag (ET for both Avi3a177 and S52).

In FIGS. 6A-6B and FIGS. 7A-7B, TP29 has the sequence AIPLEVIKGGRHLIFCHSKKKCDELAAKL (SEQ ID NO: 1); TP52 has the sequence AIPLEVIKGGRHLIFCHSKK-KCDELAAKLVALGINAVAYYRGLDVSVIPTSG (SEQ ID NO:2); and TP100 has the sequence VALSTTGEIPFYG-KAIPLEVIKGGRHLIFCHSKKKCDELAAKLVALGI-NAVAYYRGLDVS VIPTSGDVVVVATDALMTGFTGD-FDSVIDCNTCVTQTVDF (SEQ ID NO:4).

Methods for purification of Fc-tagged E1E2 with or without T-cell polytope (TPx) extensions from CHO cell extracts.

As shown in FIGS. 8A-8B, the following purification strategy results in capture of the Fc-tagged E1E2 glycoproteins (wild type or T cell polytope (TPx) extensions) by Protein G Sepharose chromatography medium, tag removal by PreScission Protease and the isolation of E1E2 heterodimers.

CHO cells stably expressing the Fc-tagged E1E2 expression vectors were pelleted, washed twice in sterile phosphate buffered saline (PBS) and frozen at −80° C. Frozen cell pellets were homogenized in lysis buffer (20 mM TRIS, 100 mM NaCl, 1 mM EDTA, 2% TX-100 pH 7.5) containing protease inhibitor cocktail (Calbiochem; 539134) by pipetting and incubated on ice for 30 minutes. Cell debris was removed by centrifugation for 15 min at 12000 g 4° C. using a JA25.5 rotor and Avanti J-26 XPI centrifuge (Beckman Coulter). Soluble cell extract (supernatant fraction) was filtered using a Stericup vacuum-driven filtration unit (Millipore SCGPU01RE).

Filtered cell extracts were bound to Protein G Sepharose 4 Fast Flow (GE; 17-0618-02) in batch mode (1 ml Protein G Sepharose: 1 g CHO cell extract in 40-50 ml volume) for 2 hours at 4° C. with gentle rotation. The Protein G Sepharose resin was sedimented by centrifugation at 200 g for 5 min in an Allegra X-15R swinging bucket centrifuge (Beckman Coulter). Unbound cell extract was removed and the Protein G Sepharose was washed in 15 ml final volume with wash buffer (20 mM TRIS, 150 mM NaCl, 0.5% TX-100 pH 7.5) for 10 minutes at 4° C. with gentle rotation. The Protein G Sepharose was sedimented by centrifugation at 200 g for 5 min and the wash step repeated two more times. The resin was resuspended to a final volume of 5 ml in digestion buffer (20 mM HEPES, 250 mM NaCl, 5% glycerol pH 7.5) containing GST-tagged PreScission Protease (GST-PP) (50 µg) and incubated overnight (16-20 hours) with gentle rotation at 4° C.

Following incubation with GST-PP, the Protein G Sepharose was transferred to a Poly-Prep chromatography column (Biorad; 731-1550) and the unbound material and 2 column volume (CV) (2×1 ml) washes with digestion buffer collected. The collected flow through was then added to a 0.5 ml Glutathione Sepharose 4B (GE; 17-0756-01) column (pre-equilibrated with 10 CV of digestion buffer) for GST-PP removal. The Glutathione Sepharose 4B flow-through and 2 CV (2×0.5 ml) washes with digestion buffer was collected. The collected flow through was concentrated using a centrifugal filter unit (50,000 MWCO) (Amicon; UFC805024) (final volume 200-300 µl) and then diluted 10-fold in HAP buffer.

The diluted sample was applied to a hydroxyapatite type I (HAP) column; and the HAP flow through was collected. The final sample was concentrated using a centrifugal filter unit (50,000 molecular weight cutoff (MWCO)) (Amicon; UFC805024) to a final volume of 200-300 µl. Aliquots of the final antigen (10-20 µl) were stored at −80° C.

FIGS. 8A-8B. Purification of E1E2 heterodimer from CHO cell extracts expressing Fc-tagged E1E2. Fc-PP tagged wildtype or TP extension E1E2 (E1E2 heterodimer, where E2 includes a T-cell polytope) proteins from CHO cell extracts were immobilized on Protein-G Sepharose 4 Fast Flow, and digested with GST-PreScission protease (GST-PP) to remove the Fc tag. Following the digestion with GST-PP and release of untagged E1E2, GST-PP was removed by Glutathione Sepharose 4B. The untagged E1E2 protein concentrate was then applied to a HAP column. The HAP flow through containing the final E1E2 heterodimer was collected and samples loaded onto a sodium dodecyl sulfate-polyacrylamide gel electrophoresis (SDS-PAGE) gel. After electrophoresis, the gel was stained, or blotted then probed with antibodies. (A) Western blot with anti-E1 (A4) and anti-E2 (H52) monoclonal antibodies (mAbs) (0.5 µg loaded per lane). (B) Colloidal Coomassie Brilliant Blue G250 stained gel (2 µg loaded per lane). Lanes: (1) wild-type E1E2 (no TP extension); (2) E1-TP29-E2; (3) E1-TP52-E2; and (4) E1-TP100-E2. E1-TP29-E2: E1-E2 heterodimer, where E2 includes a 29-amino acid T-cell polytope ("TP29") as set forth in FIGS. 14A-D; E1-TP52-E2: E1-E2 heterodimer, where E2 includes a 52-amino acid T-cell polytope ("TP52") as set forth in FIGS. 14A-D; and E1-TP100-E2: E1-E2 heterodimer, where E2 includes a 100-amino acid T-cell polytope ("TP100") as set forth in FIGS. 14A-D.

Example 3

Analysis of E1/E2 Heterodimers

Immunization of Mice with Recombinant gpE1/gpE2 Antigens

CB6F1 mice were injected intramuscular (IM) with recombinant gpE1/gpE1 antigens at day 0, 14 and 28 days. Pre-vaccination serum was collected at day 0 at the time of the first injection and test bleeds obtained by jugular puncture at 28 days. Terminal bleeds are performed at day 42. In some cases, an extended protocol for immunizations may be applied with a fourth injection administered at day 56 and terminal bleed collected on day 70. Blood samples were centrifuged at 5000 g and serum collected and heat inactivated by incubation at 56° C. for 30 minutes. Serum samples were stored in aliquots at −80° C. until use.

Determination of Neutralizing Antibodies (nAb) Response to HCV from Immunized Mice HCVcc Assay Methods for detecting nAb responses from the sera of immunized animals by HCV cell culture-derived virus (HCVcc) are similar to those described previously (Law, J. et al. 2013. Plos One 8(3) e59776). Human hepatoma cells (Huh7.5) were plated on poly-lysine coated 96 well plates, 1 day prior to infection. For infection, 100 TCID50 HCV cell culture-derived virions (HCVcc) were premixed with heat inactivated sera diluted at 1 in 50 (by volume), for 1 hour at 37° C. followed by adding to cells. 12 hour post-infection, the antibody-virus inoculum was replaced with fresh culture media. Cells were fixed 48 hours post-infection with methanol using previously described methods. Infection was determined by quantitation of NS5A-positive foci using mouse monoclonal NS5A antibody (9E10). Foci were detected and counted using a CTL S6 immunospot analyzer. The percentage of neutralization was calculated in comparison to pre-vaccination serum. The neutralization activity was calculated using the following formula: % neutralization=(pre-post)/pre×100% where pre/post represent the number of NS5A-positive foci done after incubating with either the pre- or post-vaccination sera.

HCVpp Assay

Pseudotyped viruses enclosed by HCV glycoproteins (HCVpp) were generated by co-transfecting plasmids encoding HIV provirus expressing Luciferase and the HCV envelope glycoproteins (gpE1/gpE2) as previously described (Hsu et al. (2003) Proc. Natl. Acad. Sci. USA 100(12) 7271-7276). On the day prior to transfection $8 \times 10^5$ 293T cells were seeded in a 35 mm well. The following day a total of 1.5 µg DNA was transfected using Fugene 6 or other transfection reagent and media replaced after 6 h post-transfection. Supernatants containing HCVpp were harvested at 48 h and 72 h after transfection, pooled and filtered. Neutralization assays with immunized animal sera were performed as described for the HCVcc neutralization assay. Human hepatoma cells (Huh7.5) were plated on poly-lysine coated 96-well plates. 1 day prior to infection. HCVpp were diluted 1/10 and premixed with heat inactivated sera diluted at 1 in 50 (by volume) for 1 hour at 37° C. followed by adding to cells. 12 hour post-infection, the antibody-virus inoculum was replaced with fresh culture media. Cells were processed 48 hours post-infection using Bright-glo luciferase assay system (Promega). Luminescence was measured using an Enspire plate reader (Perkin Elmer). The neutralization activity was calculated using the following formula: % neutralization=(pre-post)/pre×100% where pre/post represent the luciferase activity done after incubating with either the pre- or post-vaccination sera.

Determination of Anti-gpE2 Specific Antibodies from Immunized Mice

Detection of anti-gpE2 antibodies from immunized mice were determined using recombinant gpE2 enzyme-linked immunosorbent assay (ELISA). Briefly, recombinant gpE2 (amino acids 384-661) was coated to 96-well microtiter plates in carbonate buffer (15 mM sodium carbonate, 35 mM sodium bicarbonate, pH 9.6) overnight at 4° C. Wells were then blocked for one hour at room temperature with 200 µl of phosphate buffered saline+0.2% non-ionic detergent TWEEN-20™ (PBST) containing 5% bovine serum albumin (BSA). Wells were washed three times with 250 µl PBST and 50 µl of heat inactivated sera from immunized animals added per well in triplicate in PBST for one hour at room temperature. Immunized sera were examined in serial dilution (eg: 1000, 2000, 4000, etc fold dilutions) and compared to either (i) pre-vaccinated sera from the same animal or (ii) a pooled pre-vaccinated serum sample from several animals. Wells were washed three times with 250 µl PBST and incubated for one hour with horseradish peroxidase (HRP) conjugated goat anti-mouse antibody at room temperature. HRP-activity was detected using peroxidase substrate and absorbance read at 450 nm-570 nm using an Enspire plate reader (Perkin Elmer).

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (197 sequences)

SEQ ID NO: 1 - protein, 29 aa, Artificial sequence
  Synthetic amino acid sequence
AIPLEVIKGGRHLIFCHSKKKCDELAAKL

SEQ ID NO: 2 - protein, 52 aa, Artificial sequence
  Synthetic amino acid sequence
AIPLEVIKGGRHLIFCHSKKKCDELAAKLVALGINAVAYYRGLDVSVIPTSG

SEQ ID NO: 3 - protein, 70 aa, Artificial sequence
  Synthetic amino acid sequence
KGGRHLIFCHSKKKCDELAAKLVALGINAVAYYRGLDVSVIPTSGDVVVVATDALMTGFTGDFDSVIDCN

SEQ ID NO: 4 - protein, 100 aa, Artificial sequence
  Synthetic amino acid sequence
VALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDF

SEQ ID NO: 5 - protein, 8 aa, Artificial sequence
  Synthetic amino acid sequence
LEVLFQGP

SEQ ID NO: 6 - protein, 7 aa, Artificial sequence
  Synthetic amino acid sequence
ENLYTQS

SEQ ID NO: 7 - protein, 5 aa, Artificial sequence
  Synthetic amino acid sequence
DDDDK

SEQ ID NO: 8 - protein, 4 aa, Artificial sequence
  Synthetic amino acid sequence
LVPR

SEQ ID NO: 9 - protein, 191 aa, Artificial sequence
  Synthetic amino acid sequence
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASA

SEQ ID NO: 10 - protein, 228 aa, Artificial sequence
  Synthetic amino acid sequence
LHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCN

SEQ ID NO: 11 - protein, 50 aa, Artificial sequence
  Synthetic amino acid sequence
LGALTGTYVYNHLTPLRDWAHNGLRDLAVAVEPVVFSQMETKLITWGADT

SEQ ID NO: 12 - protein, 553 aa, Artificial sequence
  Synthetic amino acid sequence
QASLLKVPYFVRVQGLLRICALARKMAGGHYVQMAIIKLGALTGTYVYNALTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDSRGSLLSPRPISYLKGSAGGPLLCPAGHAVGIFRAAVCTRGVAKAVDFIPVENLETTMRSPVFTDNSSPPAVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCN

SEQ ID NO: 13 - protein, 1985 aa, Artificial sequence
  Synthetic amino acid sequence
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDSRGSLLSPRPISYLKGSAGGPLLCPAGHAVGIFRAAVCTRGVAKAVDFIPVENLETTMRSPVFTDNSSPPAVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDFSLDPTFTIETTTLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPITKYIMTCMSADLEVVTSTWVLVGGVLAALAAYCLSTGCVVIVGRIVLSGKPAIIPDREVLYREFDEMEECSQHLPYIEQGMMLAEQFKQKALGLLQTASRQAEVIAPAVQTNWQKLEAFWAKHMWNFISGIQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGGNITRVESENKVVILDSFDPLVAEEDEREISVPAEILRKSRRFAPALPIWARPDYNPPLLETWKKPDYEPPVVHGCPLPPPQSPPVPPPRKKRTVVLTESTVSTALAELATKSFGSSSTSGITGDNTTTSSEPAPSGCPPDSDAESYSSMPPLEGEPGDPDLSDGSWSTVSSEADTEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVFPDLGVRVCEKMALYDVVSKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGNNLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARSVRARLLSRGGRAAICGKYLFNWAVRTKLKLTPIAAAGQLDLSGWFTAGYSGGDIYHSVSHARPRWFWFCLLLLAAGVGIYLLPNR

SEQ ID NO: 14 - protein, 14 aa, Artificial sequence
  Synthetic amino acid sequence
QYIKANSKFIGIFE

SEQ ID NO: 15 - protein, 124 aa, Artificial sequence
  Synthetic amino acid sequence
MIKLKFGVFFTVLLSSAYAHGTPQNITDLCAEYHNTQIHTLNDKIFSYTESLAGKREMAIITFKNGATFQVEVPGSQHIDSQKKAIERMKDTLRIAYLTEAKVEKLCVWNNKTPHAIAAISMAN

SEQ ID NO: 16 - protein, 15 aa, Artificial sequence
  Synthetic amino acid sequence
ILMQYIKANSKFIGI

SEQ ID NO: 17 - protein, 7 aa, Artificial sequence
  Synthetic amino acid sequence
VNNESSE

SEQ ID NO: 18 - protein, 17 aa, Artificial sequence
  Synthetic amino acid sequence
PGINGKAIHLVNNESSE

SEQ ID NO: 19 - protein, 6 aa, Artificial sequence
  Synthetic amino acid sequence
PNRDIL

SEQ ID NO: 20 - protein, 7 aa, Artificial sequence
  Synthetic amino acid sequence
FIGITEL

SEQ ID NO: 21 - protein, 6 aa, Artificial sequence
  Synthetic amino acid sequence
SYFPSV

SEQ ID NO: 22 - protein, 20 aa, Artificial sequence
  Synthetic amino acid sequence
NSVDDALINSTKIYSYFPSV

SEQ ID NO: 23 - protein, 20 aa, Artificial sequence
  Synthetic amino acid sequence
IDKISDVSTIVPYIGPALNI

SEQ ID NO: 24 - protein, 15 aa, Artificial sequence
  Synthetic amino acid sequence
QSIALSSLMVAQAIP

SEQ ID NO: 25 - protein, 19 aa, Artificial sequence
  Synthetic amino acid sequence
PVFAGANYAAWAVNVAQVI

SEQ ID NO: 26 - protein, 20 aa, Artificial sequence
  Synthetic amino acid sequence
VHHNTEEIVAQSIALSSLMV

SEQ ID NO: 27 - protein, 534 aa, Homo sapiens
ADDVVDSSKSFVMENFSSYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKS

SEQ ID NO: 28 - protein, 26 aa, Artificial sequence
  Synthetic amino acid sequence
IMQYIKANSKFIGIQSIALSSLMVAQ

SEQ ID NO: 29 - protein, 25 aa, Artificial sequence
  Synthetic amino acid sequence
SLAGKREMAIITFKNGATFQVEVPG

SEQ ID NO: 30 - protein, 10 aa, Artificial sequence
  Synthetic amino acid sequence
CGLVPAGSGP

SEQ ID NO: 31 - protein, 12 aa, Artificial sequence
  Synthetic amino acid sequence
SLLKSRMVPNFN

SEQ ID NO: 32 - protein, 12 aa, Artificial sequence
  Synthetic amino acid sequence
SLLIARRMPNFN

SEQ ID NO: 33 - protein, 12 aa, Artificial sequence
  Synthetic amino acid sequence
SKLVQASASGVN

SEQ ID NO: 34 - protein, 12 aa, Artificial sequence
  Synthetic amino acid sequence
SSYLKASDAPDN

SEQ ID NO: 35 - protein, 12 aa, Artificial sequence
  Synthetic amino acid sequence
RPKPQQFFGLMN

SEQ ID NO: 36 - protein, 12 aa, Artificial sequence
  Synthetic amino acid sequence
SLRPLALWRSFN

SEQ ID NO: 37 - protein, 12 aa, Artificial sequence
  Synthetic amino acid sequence
SPQGIAGQRNFN

SEQ ID NO: 38 - protein, 14 aa, Artificial sequence
  Synthetic amino acid sequence
DVDERDVRGFASFL

SEQ ID NO: 39 - protein, 12 aa, Artificial sequence
  Synthetic amino acid sequence
SLPLGLWAPNFN

SEQ ID NO: 40 - protein, 12 aa, Artificial sequence
  Synthetic amino acid sequence
SLLIFRSWANFN

SEQ ID NO: 41 - protein, 12 aa, Artificial sequence
  Synthetic amino acid sequence
SGVVIATVIVIT

SEQ ID NO: 42 - protein, 12 aa, Artificial sequence
  Synthetic amino acid sequence
SLGPQGIWGQFN

SEQ ID NO: 43 - protein, 12 aa, Artificial sequence
  Synthetic amino acid sequence
KKSPGRVVGGSV

SEQ ID NO: 44 - protein, 12 aa, Artificial sequence
  Synthetic amino acid sequence
PQGLLGAPGILG

SEQ ID NO: 45 - protein, 31 aa, Artificial sequence
  Synthetic amino acid sequence
HGPEGLRVGFYESDVMGRGHARLVHVEEPHT

SEQ ID NO: 46 - protein, 12 aa, Artificial sequence
  Synthetic amino acid sequence
GPQGLAGQRGIV

SEQ ID NO: 47 - protein, 12 aa, Artificial sequence
  Synthetic amino acid sequence
GGSGQRGRKALE

SEQ ID NO: 48 - protein, 12 aa, Artificial sequence
  Synthetic amino acid sequence
SLSALLSSDIFN

SEQ ID NO: 49 - protein, 12 aa, Artificial sequence
  Synthetic amino acid sequence
SLPRFKIIGGFN

SEQ ID NO: 50 - protein, 12 aa, Artificial sequence
  Synthetic amino acid sequence
SLLGIAVPGNFN

SEQ ID NO: 51 - protein, 12 aa, Artificial sequence
  Synthetic amino acid sequence
FFKNIVTPRTPP

SEQ ID NO: 52 - protein, 8 aa, Artificial sequence
  Synthetic amino acid sequence
DYKDDDDK

SEQ ID NO: 53 - protein, 9 aa, Artificial sequence
  Synthetic amino acid sequence
YPYDVPDYA

SEQ ID NO: 54 - protein, 10 aa, Artificial sequence
  Synthetic amino acid sequence
EQKLISEEDL

SEQ ID NO: 55 - protein, 5 aa, Artificial Sequence
  synthetic peptide sequence
GSGGS

SEQ ID NO: 56 - protein, 4 aa, Artificial Sequence
  synthetic peptide sequence
GGGS

SEQ ID NO: 57 - protein, 4 aa, Artificial Sequence
  synthetic peptide sequence
GGSG

SEQ ID NO: 58 - protein, 5 aa, Artificial Sequence
  synthetic peptide sequence
GGSGG

SEQ ID NO: 59 - protein, 5 aa, Artificial Sequence
  synthetic peptide sequence
GSGSG

SEQ ID NO: 60 - protein, 5 aa, Artificial Sequence
  synthetic peptide sequence
GSGGG

SEQ ID NO: 61 - protein, 5 aa, Artificial Sequence
  synthetic peptide sequence
GGGSG

SEQ ID NO: 62 - protein, 5 aa, Artificial Sequence
  synthetic peptide sequence
GSSSG

SEQ ID NO: 63 - protein, 171 aa, Artificial Sequence
  sythetic amino acid sequence
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPG

SEQ ID NO: 64 - protein, 778 aa, Artificial Sequence
  sythetic amino acid sequence
LHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDFSLDPTFTIETTTLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPITKYIMTCMSADLEVVTSTWVLVGGVLAALAAYCLSTGCVVIVGRIVLSGKPAIIPDREVLYREFDEMEECSQHLPYIEQGMMLAEQFKQKALGLLQTASRQAEVIAPAVQTNWQKLEAFWAKHMWNFISGIQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPG

SEQ ID NO: 65 - protein, 14 aa, Artificial Sequence
  synthetic peptide sequence
QYIKANSKFIGITE

SEQ ID NO: 66 - protein, 20 aa, Artificial Sequence
  synthetic peptide sequence
QSIALSSLMVAQAIPLVGEL

SEQ ID NO: 67 - protein, 20 aa, Artificial Sequence
  synthetic peptide sequence
VDIGFAAYNFVESIINLFQV

SEQ ID NO: 68 - protein, 20 aa, Artificial Sequence
  synthetic peptide sequence
QGESGHDIKITAENTPLPIA

SEQ ID NO: 69 - protein, 20 aa, Artificial Sequence
  synthetic peptide sequence
GVLLPTIPGKLDVNKSKTHI

SEQ ID NO: 70 - protein, 4 aa, Artificial Sequence
  synthetic peptide sequence
  MISC_FEATURE (2)..(3): X can be any amino acid
  MISC_FEATURE (4)..(4): X can be any hydrophobic amino acid
PXXX

SEQ ID NO: 71 - protein, 5 aa, Artificial Sequence
  synthetic peptide sequence
  MISC_FEATURE (2)..(3): X can be any amino acid
  MISC_FEATURE (4)..(4): X can be any hydrophobic amino acid
  MISC_FEATURE (5)..(5): X can be Ser or Thr
PXXXX

SEQ ID NO: 72 - protein, 6 aa, Artificial Sequence
  synthetic peptide sequence
  MISC_FEATURE (2)..(2): X can be Leu or Gln
PXGMTS

SEQ ID NO: 73 - protein, 5 aa, Artificial Sequence
  synthetic peptide sequence
  MISC_FEATURE (2)..(2): X can be Leu or Gln
PXGMT

SEQ ID NO: 74 - protein, 746 aa, Artificial Sequence
  synthetic amino acid sequence
  misc_feature (248)..(248): Xaa can be any naturally occurring amino acid
  misc_feature (262)..(262): Xaa can be any naturally occurring amino acid
  misc_feature (270)..(270): Xaa can be any naturally occurring amino acid
  misc_feature (275)..(275): Xaa can be any naturally occurring amino acid
  misc_feature (399)..(399): Xaa can be any naturally occurring amino acid
  misc_feature (408)..(408): Xaa can be any naturally occurring amino acid
  misc_feature (524)..(524): Xaa can be any naturally occurring amino acid
  misc_feature (580)..(580): Xaa can be any naturally occurring amino acid
  misc_feature (641)..(641): Xaa can be any naturally occurring amino acid
  misc_feature (709)..(709): Xaa can be any naturally occurring amino acid
  misc_feature (733)..(733): Xaa can be any naturally occurring amino acid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADTILHSPGCVPCVREGNASRCWVALTPTVAXRDGSLPTTQLRRHXDLLVGSAXLCSAXYVGDLCGSVFLVGQLFTFSPRRHWTTQDCNCSIYPGHITGHRMAWDMMMNWSPTTALVVAQLLRIPQAILDMIAGAHWGVLAGIAYFSMVGNWAKVLVVLLLFAGVDAETHVTGGSAARATSGXASLFSPGAXQNIQLINTNGSWHINRTALNCNDSLDTGWVAGLFYYHKFNSSGCPERMASCRPLADFDQGWGPISYANGSGPDQRPYCWHYPPKPCGIVPAQQVCGPVYCFTPSPVVVGTTDRLGXPTYNWGENETDVLVLNNTRPPLGNWFGCTWMNSTGFTKVCGAPPCNIGGVGNNTLXCPTDCFRKHPEATYSRCGSGPWLTPRCLVDYPYRLWHYPCTVNYTIFKVRMYVGGVEHRLXAACNWTRGERCDLDDRDRSELSPLLLSTTQWQVLPCSFTTLPALSTGLIHLHQNIVDVQYLYGVGSSXVSWAIKWEYVILLFLLLADARICXCLWMMLLISQAEA

SEQ ID NO: 75 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGLYHVTNDCPNSSIVYEAADAILHTPGCVPCVREGNTSRCWVAMTPTVATRDGKLPTTQLRRHIDLLVGSATLCSALYVGDLCGSIFLVGQMFTFSPRRHWTTQDCNCSLYPGHITGHRMAWDMMMNWSPTAALITAQLLRIPQAILDMIAGAHWGVLAGIAYFSMVGNWAKVLVVLLLFAGVDAQTHVTGGRAAHITAGLTSLFSPGPSQKLQLVNTNGSWHINSTALNCNDSLKTGWIAGLLYSYKFNSSGCPERLASCRRLTDFAQGWGPISHANGSGPDERPYCWHYPPRPCGIVPAKSVCGPVYCFTPSPVVVGTTDKSGAPTYNWGENDTDVFVLNNTRPPLGNWFGCTWMNSTGFTKVCGAPPCVIGGAGNNTLRCPTDCFRKHPDATYSRCGSGPWITPRCLVDYPYRLWHYPCTVNYSIFKIRMYLGGVEHRLEAACNWTRGERCDLEDRDRSELSPLLLSTTQWQVLPCSFTTLPALSTGLIHLHQNIVDVQYLYGVGSSVASWAIKWDYVVLLFLLLADARICSCLWMMLLISQAEA

SEQ ID NO: 76 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETHVTGGSAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEA

SEQ ID NO: 77 - protein, 746 aa, Hepatitis C virus
MSTNPKPQRKTKRNTNRRPQDVKFPGGGQIVGGVYLLPRRGPRLGVRAVRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGIYHVTNDCPNSSIVYETADTILHSPGCVPCVREGNASKCWVALAPTVATRDGKLPTTQLRRHIDLLVGSATLCSALYVGDLCGSVFLVGQLFTFSPRRHWTTQDCNCSIYPGHITGHRMAWDMMMNWSPTTALVVAQLLRVPQAILDMIAGAHWGVLAGIAYFSMVGNWAKVLVVLLLFAGVDAETYTTGGSVAQAAFGLTSLFRPGPKQDIQLINTNGSWHINRTALNCNASLDTGWVAGLFYYHKFNSSGCPERMASCRSLADFDQGWGPISYANGSGPEHRPYCWHYPPKPCGIVPAQNVCGPVYCFTPSPVVVGTTNKLGVPTYSWGSNETDVLVLNNTRPPLGNWFGCTWMNSSGFTKVCGAPPCVIGGAGNRTLHCPTDCFRKHPEATYSRCGSGPWITPRCLVHYPYRLWHYPCTVNYTMFKVRMYVGGVEHRLEVACNWTRGERCDLDDRDRSELSPLLLSTTQWQVLPCSFTTLPALTTGLIHLHQNIVDVQYLYGVGSSIVSWAIKWEYVILLFLLLADARICSCLWMMLLISQAEA

SEQ ID NO: 78 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRSWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAFQVRNSSGLYHVTNDCPNSSIVYETADTILHSPGCVPCVREDNTSRCWVAVAPTVATRDGRLPTTQLRRHIDLLVGSATLCSALYVGDLCGSVFLVGQLFTFSPRRHWTTQDCNCSIYPGHITGHRMAWDMMMNWSPTTALVVAQLLRVPQAILDMIAGAHWGVLAGIAYFSMVGNWAKVLVVLLLFASVDAETYTSGGSVARATAGFAGIFNPGAKQDIQLINTNGSWHINRTALNCNASLDTGWVAGLFYYHKFNSSGCPERMASCKPLAHFAQGWGPISYANGSGPDHRPYCWHYPPKPCGIVPAQNVCGPVYCFTPSPVVVGTTNKLGAPTYNWGSNDTDVFILNNTRPPGGNWFGCTWMNSSGFTKVCGAPPCTIGGVGNNTLLCPTDCFRKHPEATYSRCGSGPWVTPRFLVHYPYRLWHYPCTVNYTLFKVRMYVGGVEHRLEVACNWTRGERCDLDDRDRSELSPLLLSTTQWQVLPCSFTTLPALTTGLIHLHQNIVDVQYLYGVGSSLVSWAIKWEYVILLFLLLADARICSCLWMMLLISQAEA

SEQ ID NO: 79 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADTILHSPGCVPCVREGNTSKCWVAVAPTVATRDGKLPTTQLRRHIDLLVGSATLCSALYVGDLCGSVFLVGQLFTFSPRRHWTTQDCNCSIYPGHITGHRMAWDMMMNWSPTAALVTAQLLRVPQAILDMIAGAHWGVLAGIAYFSMAGNWAKVLLVLLLFAGVDAETYTTGGSVARTTRGLASLLQVGPKQDIRLIHTNGSWHINRTALNCNASLDTGWLAGLLYYHKFNSSGCPERMASCRPLADFDQGWGPISYANGSGPEHRPYCWHYPPKPCGIVPAQTVCGPVYCFTPSPVVVGTTNKLGVPTYTWGSNDTDVFVLNNTRPPLGNWFGCTWMNSTGFTKVCGAPPCVIGGVGNNTLHCPTDCFRKHPEATYSRCGSGPWITPRCLVDYPYRLWHYPCTVNYTLFKVRMYVGGVEHRLQAACNWTRGERCDLDDRDRSELSPLLLSTTQWQVLPCSFTTLPALTTGLIHLHQNIVDVQYLYGVGSSIVSWAIKWEYVILLFLLLADARICSCLWMMLLISQAEA

SEQ ID NO: 80 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADTILHSPGCVPCVREDNASRCWVPVAPTVATRDGKLPTTQLRRHIDLLVGSATLCSALYVGDLCGSVFLVSQLFTFSPRRHWTTQDCNCSIYPGHITGHRMAWDMMMNWSPTVALVMAQLLRVPQAILDMIAGAHWGVLAGIAYFSMVGNWAKVLVVLLLFAGVDAQTYVTGGSAARGASGLANLFTPGAKQDIQLINTNGSWHINRTALNCNASLDTGWVAGLFYYHKFNSSGCPERMASCKPLADFDQGWGPIRHANGSGPEHRPYCWHYPPKPCGIVSAQTVCGPVYCFTPSPVVVGTTNRLGVPTYSWGTNDTDVFVLNNTRPPLGNWFGCTWMNSSGFTKVCGAPPCVIGGVGNNTLHCPTDCFRKHPEATYSRCGSGPWITPRCLVHYPYRLWHYPCTVNYTLFKVRMYVGGVEHRLEVACNWTRGERCDLDDRDRSELSPLLLSTTQWQVLPCSFTTLPALTTGLIHLHQNIVDVQYLYGVGSSIVSWAIKWEYVILLFLLLADARICSCLWMMLLISQAEA

SEQ ID NO: 81 - protein, 746 aa, Hepatitis C virus
MSTNPKPQRKTKRNTNRRPQDVKFPGGGQIVGGVYLLPRRGPRLGVRTTRKTSERSEPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETKDTILHSPGCVPCVREGNVSKCWVPVALTVATRDGNLPTTQLRRHIDLLVGSATLCSALYVGDLCGSVFLVGQLFTFSPRRHWTTQDCNCSMYPGHITGHRMAWDMMMNWSPTSALVVAQLLRVPQAILDMIAGAHWGVLAGLAYFSMVGNWAKVLVVLLLFASVDAGTHVTGGSAAHDVSALAGFFRRGAKQNIQLINTNGSWHVNRTALNCNASLDTGWVAGLLYYHRFNSSGCPERMASCRPLADFDQGWGPITNVDGGGSEYRPYCWHYPPKPCGIEPAQNVCGPVYCFTPSPVVVGTTDKVGVPTYNWGENDTDVFVLNNTRPPLGNWFGCTWMNSSGFVKVCGAPPCIIGGAGNKTLHCPTDCFRKHPDATYSRCGSGPWLTPRCLVDYPYRLWHYPCTVNYTLFKIRMYVGGVEHRLVAACNWTYGERCNLDDRDRSELSPLLLSTTQWQVLPCSFTTLPALTTGLIHLHQNIVDVQYLYGVGSSIVSWAIKWEYVILLFLLLADARICSCLWMMLLISQAEA

SEQ ID NO: 82 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADTILHSPGCVPCVREGNASKCWVAVAPTVATRDGTLPTTQLRRHIDLLVGGATLCSALYVGDLCGSVFLVGQLFTFSPRRHWTTQDCNCSIYPGHITGHRMAWDMMMNWSPTTALIVAQLLRVPQAILDMIAGAHWGVLAGIAYFSMVGNWAKVLVVLLLFAGVDAETHVTGGSAAQVTSRVAGFFNPGPKQNVQLINTNGSWHINRTALNCNASLDTGWVAGLFYHYNFNSSGCPERMASCRPLADFDQGWGPISYANGSGPEHRPYCWHYPPKPCGIVPAQNVCGPVYCFTPSPVVVGTTNRLGVPTYNWGSNDTDVFVLNNTRPPLGNWFGCTWMNSSGFTKVCGAPPCVIGGVGNNTLHCPTDCFRKHPEATYSRCGSGPWITPRCLVHYPYRLWHYPCTVNYTLFKVRMYVGGVEHRLEAACNWTRGERCDLDDRDRSELSPLLLSTTQWQVLPCSFTTLPALTTGLIHLHQNIVDVQYLYGVGSSIVSWAIKWEYVILLFLLLADARICSCLWMMLLISQAEA

SEQ ID NO: 83 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRSWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGIYHVTNDCPNSSIVYETADTILHSPGCVPCVREGNASKCWVALAPTVATRDGRLPTTQLRRHIDLLVGSATLCSALYVGDLCGSVFLVGQLFTFSPRRHWTTQDCNCSIYPGHITGHRMAWDMMMNWSPTTALVVAQLLRIPQAILDMIAGAHWGVLAGIAYFSMVGNWAKVLVVLLLFAGVDAHTRVTGGSAARATARLTTLFSPGAKQDIQLINTNGSWHINRTALNCNASLDTGWVAGLFYYHKFNSSGCPERMASCRPLADFDQGWGPISYANGSGPEHRPYCWHYPPKPCGIIPAKTVCGPVYCFTPSPVVVGTTDRSGAPTFNWGDNDTDVLVLNNTRPPLGNWFGCTWMNSSGYTKVCGAPPCIIGGVGNNTLHCPTDCFRKHPEATYSRCGSGPWITPRCLVHYPYRLWHYPCTVNYTLFKVRMYVGGVEHRLEAACNWTRGERCNLDDRDRSELSPLLLSTTQWQVLPCSFTTLPALTTGLIHLHQNIVDVQYLYGVGSSIVSWAIKWEYVILLFLLLADARVCSCLWMMLLISQVEA

SEQ ID NO: 84 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADTILHSPGCVPCVREGNASKCWVAVTPTVATRDGRLPATQLRRHIDLLVGSATLCSALYVGDLCGSIFLVGQLFTFSPRRHWTTQDCNCSIYPGHITGHRMAWDMMMNWSPTTALVVAQLLRVPQAILDMIAGAHWGVLAGIAYFSMVGNWAKVLVVLLLFAGVDAGTHVTGGSAAKDTSGFTSLFRIGARQNIQLINSNGSWHINRTALNCNESLDTGWVAGLLYYHKFNSSGCPERMASCRSLADFDQGWGPISYANGSGPEHRPYCWHYPPKPCGIVPAQSVCGPVYCFTPSPVVVGTTDKSGAPTYNWGCNETDVFVLNNTRPPLGNWFGCTWMNSSGFTKVCGAPPCVIGGVGNNTLHCPTDCFRKHPEATYSRCGSGPWITPRCLVHYAYRLWHYPCTVNYTLFKVRMYVGGVEHRLDVACNWTRGERCNLDDRDRSELSPLLLSTTQWQVLPCSFTTLPALSTGLIHLHQNIVDVQYLYGVGSSIVSWAIKWEYVILLFLLLADARICSCLWMMLLISQAEA

SEQ ID NO: 85 - protein, 746 aa, Hepatitis C virus; identical to SEQ ID NO: 84

SEQ ID NO: 86 - protein, 746 aa, Hepatitis C virus; identical to SEQ ID NO: 84

SEQ ID NO: 87 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADSILHSPGCVPCVREGNASKCWVAVAPTVATRDGKLPATQLRRHIDLLVGSATLCSALYVGDLCGSVFLVSQLFTFSPRRHWTTQDCNCSIYPGHITGHRMAWDMMMNWSPTTALVVSQLLRVPQAILDMIAGAHWGVLAGIAYFSMVGNWAKVLVVLLLFAGVDAETHTTGGSAAYATSGFVGLFRQGAKQNIQLINTNGSWHVNRTALNCNASLDTGWVAGLFYYHKFNSSGCPERLASCKPLANFDQGWGSISYTNGSGPEHRPYCWHYPPKPCGIVPAQNVCGPVYCFTPSPVVVGTTDRLGAPTFNWGENESDVFVLNNTRPPSGNWFGCTWMNSSGFTKVCGAPPCNIGGVGNNTLHCPTDCFRKHPEATYSRCGSGPWVTPRCLVHYPYRLWHYPCTLNYSLFKVRMYVGGIEHRLEVACNWTRGERCNLDDRDRSELSPLLLTTTQWQVLPCSFTTLPALTTGLIHLHQNVVDVQYLYGVGSSIVSWAIKWEYVILLFLLLADARICSCLWMMLLISQAEA

SEQ ID NO: 88 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADTILHSPGCVPCVREGNASKCWVAVAPTVATRDGRLPTTQLRRHIDLLVGSATLCSALYVGDLCGSVFLVGQLFTFSPRHHWTTQDCNCSIYPGHITGHRMAWDMMMNWSPTTALVVAQLLRVPQAILDMIAGAHWGVLAGIAYFSMVGNWAKVLVVLLLFAGVDATTHTTGGAVAHNTRMFTSIFSLGPRQEIQLVNTNGSWHINRTALNCNASLETGWIAGLLYANRFNSSGCPERMASCKPLADFDQGWGPISYANGSGPEHRPYCWHYPPKPCGIVPAQNVCGPVYCFTPSPVVVGTTDRLGTPTYDWGSNDTDVFVLNNTRPPAGNWFGCTWMNSSGYTKVCGAPPCVIGGVSNNTLHCPTDCFRKHPEATYSRCGSGPWITPRCLVHYAYRLWHYPCTVNYTLFKVRMYVGGVEHRLEVACNWTRGERCNLDDRDRSELSPLLLSTTQWQVLPCSFTTLPALTTGLIHLHQNIVDVQYLYGVGSSIVSWAVKWEYVILLFLLLADARICSCLWMMLLISQAEA

SEQ ID NO: 89 - protein, 746 aa, Hepatitis C virus
MSTNPKPQRKTKRNTNRRPQDVKFPGGGQIVGGVYLLPRRGPRLGVRATRKTSERSQPRGRRQPIPKARQPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGVYHVTNDCSNASIVYEAADMIMHTPGCVPCVRENNSSRCWVALTPTLAARNASVPTTTIRRHVDLLVGAAALCSAMYVGDLCGSVFLVAQLFTFSPRRHETVQDCNCSIYPGHVTGHRMAWDMMMNWSPTAALVVSQLLRIPQAVVDMVAGAHWGVLAGLAYYSMVGNWAKVLIVMLLFAGVDGGTYVTGGTMAKNTLGITSLFSPGSSQKIQLVNTNGSWHINRTALNCNDSLNTGFLAALFYVHKFNSSGCPERMASCSPIDAFAQGWGPITYNESHSSDQRPYCWHYAPRPCGIVPAAQVCGPVYCFTPSPVVVGTTDRFGVPTYSWGENETDVLLLNNTRPPQGNWFGCTWMNSTGFTKTCGGPPCNIGGIGNKTLTCPTDCFRKHPEATYTKCGSGPWLTPRCLVHYPYRLWHYPCTVNFTIFKVRMYVGGVEHRLEAACNWTRGERCNLEDRDRSELSPLLLSTTEWQVLPCSFTTLPALSTGLIHLHQNVVDVQYLYGIGSAVVSFAIKWEYVLLLFLLLADARVCACLWMMLLIAQAEA

SEQ ID NO: 90 - protein, 746 aa, Hepatitis C virus
MSTNPKPQRKTKRNTNRRPQDVKFPGGGQIVGGVYLLPRRGPRLGVRATRKTSERSQPRGRRQPIPKARQPEGRAWAQPGYPWPLYGNEGMGWAGWLLSPRGSRPSWGPTDPRRRSRNLGKVIDTLTCGFADLMGYIPLVGAPLGGVARALAHGVRVVEDGVNYATGNLPGCSFSIFLLALLSCLTIPASAYEVRNVSGIYHVTNDCSNSSIVYEAADMIMHTPGCVPCVREGNSSRCWVALTPTLAARNASVPTTAIRRHVDLLVGAAAFCSAMYVGDLCGSVFLVSQLFTFSPRRHETIQDCNCSIYPGHVSGHRMAWDMMMNWSPTTALVVSQLLRIPQAIVDMVAGAHWGVLAGLAYYSMVGNWAKVLIVMLLFAGVDGETRVTGGQIARNAYSLTTLFSSGSAQNIQLINTNGSWHINRTALNCNDSLNTGFLAALFYTHKFNASGCPERLASCRPIDKFDQGWGPITYAEQGGQDQRPYCWHYAPKPCGIVSASKVCGPVYCFTPSPVVVGTTDRFGVPTYSWGENETDVLLLNNTRPPQGNWFGCTWMNGTGFTKTCGGPPCNIGGGGNNTLTCPTDCFRKHPAATYTKCGSGPWLTPRCLVDYPYRLWHYPCTANFTIFKVRMYVGGVEHRLDAACNWTRGERCNLEDRDRLELSPLLLSTTEWQVLPCSFTTLPALSTGLIHLHQNIVDVQYLYGIGSAVVSFAIKWDYIVILFLLLADARVCACLWMMLLIAQAEA

SEQ ID NO: 91 - protein, 747 aa, Hepatitis C virus
MSTNPKPQRKTKRNTNRRPQDVKFPGGGQIVGGVYLLPRRGPRLGVRAIRKTSERSQPRGRRQPIPKARRPEGRAWAQPGYPWPLYGNEGMGWAGWLLSPRGSRPSWGPTDPRRRSRNLGKVIDTLTCGLADLMGYIPLVGGPLGGAARALAHGVRVLEDGVNYATGNLPGCSFSIFLLALLSCLTVPASAHEVRNASGVYHVTNDCSNSSIVFEAADLIMHTPGCVPCVREGNSSRCWVALTPTLAARNATIPTTTIRHHVDLLVGAAALCSAMYVGDLCGSVFLVSQLFTFSPRRHATLQDCNCSIYPGHASGHRMAWDMMMNWSPTTALVVSQLLRIPQAVIDMVAGAHWGVLAGLAYYSMAGNWAKVLIVMLLFAGVDGHTLTTGGHAARLTSGFAGLFTPGPSQRIQLINTNGSWHINRTALNCNDSLQTGFLAALFYAHRFNSSGCPERMASCRSIDKFDQGWGPITYAEPTKDPDQRPYCWHYPPQQCGIVPASQVCGPVYCFTPSPVVVGTTDRLGNPTYSWGENDTDVLLLNNTRPPQGNWFGCTWMNSTGFTKTCGAPPCNIGGVGNNTLTCPTDCFRKHPEATYSKCGSGPWLTPRCMVDYPYRLWHYPCTVNFSIFKVRMYVGGVEHRLNAACNWTRGERCNLDDRDRSELSPLLLSTTEWQVLPCSFTTLPALSTGLIHLHQNIVDVQYLYGIGSAVVSFAIKWEYVVLLFLLLADARVCACLWMMLLIAQAEA

SEQ ID NO: 92 - protein, 746 aa, Hepatitis C virus
MSTNPKPQRKTKRNTNRRPQDVKFPGGGQIVGGVYLLPRRGPRLGVRATRKTSERSQPRGRRQPIPKARHPEGRTWAQPGYPWPLYGNEGLGWAGWLLSPRGSRPSWGPTDPRRRSRNLGKVIDTLTCGFADLMGYIPLVGAPLGGVARALAHGVRVLEDGVNYATGNLPGCSFSIFLLALLSCLTIPASAYEVRNVSGVYHVTNDCSNSSIVYEAADVIMHTPGCVPCVQDGNTSRCWVALTPTLAARNASVPVTAIRRHVDLLVGTAAFCSAMYVGDLCGSVFPVSQLFTFSPRRHQTVQDCNCSIYPGHISGHRMAWDMMMNWSPTAALVVSQLLRIPQAIVDMVAGAHWGVLAGLAYYSMVGNWAKVMIVLLLFAGVDGTTHTTGGAAARATQGFTSFFSLGPSQKIQLINTNGSWHINRTALNCNDSLQTGFLAALFYTYRFNASGCPERMASCRPIDKFDQGWGPITYAEPDSSDQRPYCWHYAPRPCGIVPASQVCGPVYCFTPSPVVVGTTDRFGVPTYTWGENETDVLLLNNTRPPLGNWFGCTWMNSTGFTKTCGGPPCNIGGAGNTTLTCPTDCFRKHPEATYTKCGSGPWLTPRCLVDYPYRLWHYPCAVNFTIFKVRMYVGGVEHRLNAACNWTRGERCDLEDRDRSELSPLLLSTTEWQVLPCSFTTLPALSTGLIHLHQNIVDVQYLYGIGSAVIPFAIKWEYVLLLFLLLADARVCACLWMMLLIAQAEA

SEQ ID NO: 93 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGMGWAGWLLSPRGSRPNWGPTDPRRRSRNLGKVIDTLTCGFADLMGYIPLVGAPLGGVARALAHGVRVLEDGVNYATGNLPGCSFSIFLLALLSCLTTPASAYEVRNVSGIYHVTNDCSNSSIVYEAADIIMHTPGCVPCVREKNISRCWVALTPTLAARNISVPTATIRRHVDLLVGTAAFCSAMYVGDLCGSVFLVSQLFTFSPRWHETVQDCNCSLYPGHVSGHRMAWDMMMNWSPTAALVVSQLLRIPQAVVDMVAGAHWGVLAGLAYYSMIGNWAKVLIVMLLFAGADGTTHVTGGVQAHGAYGLASLFNVGPHQKIQLVNTNGSWHINRTALNCNDTLQTGFLAALFYKHRFNASGCPERMASCRPIDKFAQGWGPITYAEPDRLDQRPYCWHYPPRPCGIVPALEVCGPVYCFTPSPVVVGTTDRFGVPTYSWGENETDVLLLNNTRPPQGNWFGCTWMNSTGYTKTCGGPPCNIGGVGNNTLTCPTDCFRKHPEATYTKCGSGPWLTPRCLVHYPYRLWHYPCTVNFTIFKVRMYVGGIEHRLDAACNWTRGERCDLEDRDRSELSPLLLSTTEWQILPCSFTTLPALSTGLIHLHRNIVDVQYLYGIGSAVVSFAIKWEYVLLLFLLLADARVCACLWMMLLIAQAEA

SEQ ID NO: 94 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGLGWAGWLLSPRGSRPSWGPNDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHAPGCVPCVRENNSSRCWVALTPTLAARNASVPTTTLRRHVDLLVGTAAFCSAMYVGDLCGSVFLISQLFTFSPRRHETVQDCNCSIYPGHVSGHRMAWDMMMNWSPTAALVVSQLLRIPQAVMDMVAGAHWGVLAGLAYYSMVGNWAKVLIVMLLFAGVDGHTRVTGGVQGHVTSTLTSLFRPGASQKIQLVNTNGSWHINRTALNCNDSLKTGFLAALFYTHKFNASGCPERMASCRSIDKFDQGWGPITYAQPDNSDQRPYCWHYAPRQCGIVPASQVCGPVYCFTPSPVVVGTTDRFGAPTYNWGDNETDVLLLNNTRPPHGNWFGCTWMNSTGFTKTCGGPPCNIRGVGNNTLTCPTDCFRKHPDATYTKCGSGPWLTPRCLVDYPYRLWHYPCTVNFTIFKVRMYVGGVEHRLDAACNWTRGERCDLEDRDRAELSPLLLSTTEWQILPCSYTTLPALSTGLIHLHQNIVDIQYLYGIGSAVVSIAIKWEYVVLLFLLLADARVCACLWMMLLIAQAEA

SEQ ID NO: 95 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGDEGMGWAGWLLSPRGSRPNWGPTDPRRRSRNLGKVIDTLTCGFADLMGYIPLVGAPLGGVARALAHGVRVLEDGVNYATGNLPGCSFSIFLLALLSCLTTPASAYEVRNVSGIYHVTNDCSNSSIVYEAADIIMHTPGCVPCVREKNTSRCWVALTPTLAARNISVPTTTIRRHVDLLVGTAAFCSAMYVGDLCGSVFLVSQLFTFSPRRHETVQDCNCSLYPGHVSGHRMAWDMMMNWSPTAALVVSQLLRIPQAIVDMVAGAHWGVLAGLAYYSMVGNWAKVLIVMLLFAGADGTTHVTGGVQAHGAYGLASLFNVGPHQKIQLVNTNGSWHINRTALNCNDTLQTGFLAALFYKHRFNASGCPERMASCRPIDKFAQGWGPITYAEPDRLDQRPYCWHYPPRPCGIVPALEVCGPVYCFTPSPVVVGTTDRFGVPTYSWGENETDVLLLNNTRPPQGNWFGCTWMNNTGFTKTCGGPPCNIGGVGNNTLTCPTDCFRKHPEATYTKCGSGPWLTPRCLVDYPYRLWHYPCTVNFTVFKVRMYVGGIEHRLDAACNWTRGERCDLEDRDRSELSPLLLSTTEWQILPCSFTTLPALSTGLIHLHRNIVDVQYLYGIGSAVVSFAIKWEYILLLFLLLADARVCACLWMMLLIAQAEA

SEQ ID NO: 96 - protein, 746 aa, Hepatitis C virus
MSTNPKPQRKTKRNTNRRPQDVKFPGGGQIVGGVYLLPRRGPRLGVRATRKTSERSQPRGRRQPIPKARQPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGVYHVTNDCSNSSIVYEAADMIMHTPGCVPCVREDNSSRCWVALTPTLAARNSSVPTTTIRRHVDLLVGAAAFCSAMYVGDLCGSVFLISQLFTFSPRRYETVQDCNCSLYPGHVSGHRMAWDMMMNWSPTTALVVSQLLRIPQAVVDMVAGAHWGVLAGLAYYSMVGNWAKVLIVMLLFAGVDGNTRVSGGEAAKNTMGFASLFVSGPSQKIQLINTNGSWHINRTALNCDDSLHTGFLAALFYAHKFNSSGCSGRMASCRPIDEFAQGWGPITHGVPDNLDQRPYCWHYAPRPCGIVPASQVCGPVYCFTPSPVVVGTTDRFGAPTYSWGENETDVLLLNNTRPPQGNWFGCTWMNSTGFTKTCGGPPCNIGGVGNNTLTCPTDCFRKHPEATYTKCGSGPWLTPRCMVDYPYRLWHYPCTVNFTIFKVRMYVGGVEHRLDAACNWTRGERCNVEDRDRSELSPLLLSTTEWQILPCSFTTLPALSTGLIHLHQNIVDVQYLYGVGSVVVSVVIRWEYVVLLFLLLADARVCACLWMMLLIAQAEA

SEQ ID NO: 97 - protein, 746 aa, Hepatitis C virus
MSTNPKPQRKTKRNTNRRPQDVKFPGGGQIVGGVYLLPRRGPRLGVRATRKTSERSQPRGRRQPIPKARQPEGRAWAQPGYPWPLYGNEGMGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGMYHVTNDCSNSSIVYEAADMILHAPGCVPCVRENNSSRCWVALTPTLAARNASVPTTAIRRHVDLLVGAAAFCSAMYVGDLCGSVLLVSQIFTFSPRRHETMQDCNCSIYPGHITGHRMAWDMMMNWSPTTALVVSQLLRIPQAIVDMVAGAHWGVLAGLAYYSMVGNWAKVLIVMLLFAGVDGGTYVTGGEAGRRTSGFASIFTPGASQNIQLINTNGSWHINRTALNCNDSLHTGFIAALFYHHKFNASGCPERMASCRPIGEFAQGWGPISYTEPPSSDQRPYCWHYPPRPCGIVPASQVCGPVYCFTPSPVVVGTTDRLGAPTYNWGDNDTDVLLLNNTRPPQGNWFGCTWMNGTGFTKTCGGPPCNIGGVGNNTLTCPTDCFRKHPEATYTKCGSGPWLTPRCIVDYPYRLWHYPCTVNFTITKIRMYVGGVEHRLTAACNWTRGERCDLEDRDRSELSPLLLSTTEWQIMPCSFTTLPALSTGLIHLHQNIVDIQYLYGIGSAAVSFAIRWEYVLLLFLLLADARVCACLWMMLLIAQAEA

SEQ ID NO: 98 - protein, 746 aa, Hepatitis C virus; identical to SEQ ID NO: 97

SEQ ID NO: 99 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGTARALAHGVRVLEDGVNYATGNLPGCSFSIFLLALLSCLTIPASAYEVRNVSGVYHVTNDCSNSSIVYETADMIMHTPGCVPCVREDNFTRCWVALTPTLAARNGSVPTTAIRRHVDLLVGAAAFCSAMYVGDLCGSVFLVSQLFTFSPRWHETVQECNCSIYPGHVTGHRMAWDMMMNWSPTTALVVSQLLRIPQAVVDMVAGAHWGVLAGLAYYSMVGNWAKVLIVTLLFAGVDGNTHTIGGKQAQATGGFVAWLARGPSQEIQLINTNGSWHINRTALNCNDSLKTGFIAALFYAHRFNSSGCPERMASCRPIDKFAQGWGPITYAKPDSLDQRPYCWHYAPQPCGIVPASEVCGPVYCFTPSPVVVGTTDRSGVPTYRWGENETDVLLLNNTRPPQGNWFGCTWMNATGFTKTCGGPPCKIGGLGNNTLTCPTDCFRKHPEATYTKCGSGPWLTPRCIVDYPYRLWHYPCTVNFTIFKVRMYVGGIEHRLSAACNWTRGERCDLEDRDRSELSPLLLSTTEWQILPCSFTTLPALSTGLIHLHQNTVDVQYLYGVGSVLVSFAIKWEYILLFFLLLADARVCACLWMMLLIAQAEA

SEQ ID NO: 100 - protein, 746 aa, Hepatitis C virus
MSTNPKPQRKTKRNTNRRPQNVKFPGGGQIVGGVCLLPRRGPRVGVRATRKTSERSQPRGRRQPIPKARRPEGRSWAQPGYPWPLYGNEGCGWAGWLLSPRGSRPSRGPSDPRRRSRNLGKVIDTLTCGFADLMGYIPLVGAPLGGAARALAHGVRVLEDGVNYATGNLPGCSFSIFLLALLSCLTVPASAVEVRNSSGIYHVTNDCPNASVVYETDSLIIHLPGCVPCVREGNASRCWVSLSPTVAAKDPGVPVNEIRRHVDLIVGAAAFCSAMYVGDLCGSIFLVGQLFTLSPRRHWTTQDCNCSIYPGHVTGHRMAWDMMMNWSPTGALVVAQLLRIPQAVLDMIAGAHWGVLAGPAYYSMVGNWAKVLVVLLLFAGVDATTQVTGGTAGRNAYRLASLFSTGPSQNIQLINSNGSWHINRTALNCNDSLHTGWVAALFYSHKFNSSGRPERMASCRPLTAFDQGWGPITYGGKASNDQRPYCWHYAPRPCGIVPAKEVCGPVYCFTPSPVVVGTTDKYGVPTYTWGENETDVLLLNNSRPPIGNWFGCTWMNSTGFTKTCGAPACNVGGSETNTLSCPTDCFRRHPDATYAKCGSGPWLNPRCMVDYPYRLWHYPCTVNYTIFKIRMFVGGIEHRLTAACNWTRGERCDLDDRDRAELSPLLLSTTQWQVLPCSFTTLPALSTGLIHLHQNIVDVQYLYGLSSVVTSWAIRWEYVVLLFLLLADARICACLWMMLLISQVEA

SEQ ID NO: 101 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTYGFADLMGYIPLVGAPLGGAARALAHGVRVLEDGVNYATGNLPGCSFSIFLLALLSCLTVPASAVGVRNSSGVYHVTNDCPNASVVYETDSLIIHLPGCVPCVREGNGSRCWVSLSPTVAAKDPGVPVNEIRRHVDLIAGAAAFCSAMYVGHLCGSIFLVGQLFTLSPRRHWTTQDCNCSIYPGHVTGHRMAWDMMMNWSPTTALVVAQLLRIPQAILDMIAGAHWGVLAGIAYFSMVGNWTKVLVVLLLFAGVDATTIVSGGSAGRSTAGLVGLFSPGARQNIQLINTNGSWHINRTALNCNDTLQTGWVAGLFYTNKFNSSGCPERLASCRPLADFDQGWGPISYTNGSGPDQRPYCWHYPPKPCGIVPAESVCGPVYCFTPSPVVVGTTDRSGAPTYNWGENETDVFVLNNTRPRLGNWFGGTWMNSTGFTKVCGAPPCAIGGVGNNTLYCPTDCFRKHPEATYSRCGSGPWITPRCLIHYPYRLWHYPCTINYTIFKIRMFVGGVEHRLDAACNWTRGERCDLDDRDRAELSPLLLSTTQWQVLPCSFTTLPALSTGLIHLHQNIVDVQYLYGLSSAVTSWVIKWEYVVLLFLLLADARICACLWMMLLISQVEA

SEQ ID NO: 102 - protein, 746 aa, Hepatitis C virus
MSTNPKPQRKTKRNTNRRPQDVKFPGGGQIVGGVYLLPRRGPRVGVRATRKTSERSQPRGRRQPIPKARRPEGRSWAQPGYPWPLYGNEGCGWAGWLLSPRGSRPSWGPSDPRRRSRNLGKVIDTLTCGFADLMGYIPLVGAPLGGAARALAHGVRVLEDGVNYATGNLPGCSFSIFLLALLSCLTVPASAVGVRNSSGVYHVTNDCPNASVVYETENLIMHLPGCVPYVREGNASRCWVSLSPTVAARDSRVPVSEVRRRVDSIVGAAAFCSAMYVGDLCGSIFLVGQIFTFSPRHHWTTQDCNCSIYPGHVTGHRMAWDMMMNWSPTGALVVAQLLRIPQAIVDMIAGAHWGVLAGLAYYSMVGNWAKVVVVLLLFAGVDAETRVTGGAAGHTAFGFASFLAPGAKQKIQLINTNGSWHINRTALNCNESLDTGWLAGLLYYHKFNSSGCPERMASCQPLTAFDQGWGPITHEGNASDDQRPYCWHYALRPCGIVPAKKVCGPVYCFTPSPVVVGTTDRAGVPTYRWGANETDVLLLNNSRPPMGNWFGCTWMNSSGFTKTCGAPACNIGGSGNNTLLCPTDCFRKHPDATYSRCGSGPWLTPRCLVDYPYRLWHYPCTVNYTIFKIRMFVGGVEHRLDAACNWTRGERCDLDDRDRAELSPLLLSTTQWQVLPCSFTTLPALSTGLIHLHQNIVDVQYLYGLSSAVTSWVIKWEYVVLLFLLLADARICACLWMMLLISQVEA

SEQ ID NO: 103 - protein, 750 aa, Artificial Sequence
  synthetic amino acid sequence
  misc_feature (233)..(233): Xaa can be any naturally occurring amino acid
  misc_feature (249)..(250): Xaa can be any naturally occurring amino acid
  misc_feature (290)..(290): Xaa can be any naturally occurring amino acid
  misc_feature (378)..(378): Xaa can be any naturally occurring amino acid
  misc_feature (392)..(392): Xaa can be any naturally occurring amino acid
  misc_feature (399)..(399): Xaa can be any naturally occurring amino acid
  misc_feature (445)..(445): Xaa can be any naturally occurring amino acid
  misc_feature (495)..(495): Xaa can be any naturally occurring amino acid
  MISC_FEATURE (599)..(599): X is a I or L
  misc_feature (628)..(628): Xaa can be any naturally occurring amino acid
  misc_feature (664)..(664): Xaa can be any naturally occurring amino acid
  misc_feature (683)..(683): Xaa can be any naturally occurring amino acid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPTDPRHRSRNVGKVIDTLTCGFADLMGYIPVVGAPLGGVARALAHGVRVLEDGVNYATGNLPGCSFSIFLLALLSCITVPVSAVEVKNISTSYMVTNDCSNDSITWQLQAAVLHVPGCVPCENDXNTSRCWIPVSPNVAVXXPGALTQGLRTHIDMVVMSATLCSALYVGDLCGGVMLAAQXFIVSPQRHWFVQECNCSIYPGTITGHRMAWDMMMNWSPTATMILAYAMRVPEVIIDIIFGAHWGVMFGLAYFSMQGAWAKVIVILLLXAGVDARTHTVGGSXGRTTSGXAGLFSSGPKQNIQLINTNGSWHINRTALNCNDSLQTGFIASLFYTXNFNSSGCPERLSACRGIEAFRIGWGTLQYEDNVTNPEDMRPYCWHYPPKXCGIVPARSVCGPVYCFTPSPVVVGTTDRLGVPTYTWGENETDVFLLNSTRPPRGSWFGCTWMNSTGFTKTCGAPPCRIRADFNASTDLLCPTDCFRKHPDATYXKCGSGPWLTPRCLVDYPYRLWHYPCTVNXTIFKIRMYVGGVEHRLTAACNFTRGDRCNLEDRDRXQLSPLLHSTTEWAILPCSXSDLPALSTGLLHLHQNIVDVQYMYGLSPALTKYIVRWEWVVLLFLLLADARVCACLWMLILLGQAEA

SEQ ID NO: 104 - protein, 750 aa, Hepatitis C virus
MSTNPKPQRKTKRNTNRRPEDVKFPGGGQIVGGVYLLPRRGPRLGVRTTRKTSERSQPRGRRQPIPKDRRSTGKAWGKPGRPWPLYGNEGLGWAGWLLSPRGSRPSWGPTDPRHRSRNVGKVIDTLTCGFADLMGYIPVVGAPLSGAARAVAHGVRVLEDGVNYATGNLPGFPFSIFLLALLSCITVPVSAAQVKNTSSSYMVTNDCSNDSITWQLEAAVLHVPGCVPCERVGNTSRCWVPVSPNMAVRQPGALTQGLRTHIDMVVMSATFCSALYVGDLCGGVMLAAQVFIVSPQYHWFVQECNCSIYPGTITGHRMAWDMMMNWSPTATMILAYVMRVPEVIIDIVSGAHWGVMFGLAYFSMQGAWAKVIVILLLAAGVDAGTTTVGGAVARSTNVIAGVFSHGPQQNIQLINTNGSWHINRTALNCNDSLNTGFLAALFYTNRFNSSGCPGRLSACRNIEAFRIGWGTLQYEDNVTNPEDMRPYCWHYPPKPCGVVPARSVCGPVYCFTPSPVVVGTTDRRGVPTYTWGENETDVFLLNSTRPPQGSWFGCTWMNSTGFTKTCGAPPCRTRADFNASTDLLCPTDCFRKHPDATYIKCGSGPWLTPKCLVHYPYRLWHYPCTVNFTIFKIRMYVGGVEHRLTAACNFTRGDRCDLEDRDRSQLSPLLHSTTEWAILPCTYSDLPALSTGLLHLHQNIVDVQYMYGLSPAITKYVVRWEWVVLLFLLLADARVCACLWMLILLGQAEA

SEQ ID NO: 105 - protein, 749 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPTDPRHRSRNVGKVIDTLTCGFADLMGYIPVVGAPLGGVARALAHGVRVLEDGVNYATGNLPGCSFSIFLLALLSCITTPVSAAQVKNTSDIYMVTNDCSNDSITWQLQAAALHVPGCVPCERVGNTSRCWIPVSPNVAVRQPGALTQGLRTHIDMVVMSATLCSALYVGDLCGGVMLAAQMFIISPQHHWFVQECNCSIYPGTITGHRMAWDMMMNWSPTTTMILAYVMRVPEVIIDIIGGAHWGVMFGLAYFSMQGAWAKVVVILLLAAGVDAHTRTGSSVGYATSGIVGLFTSGPKQNIQLINTNGSWHINRTALNCNDSLNTGFIVSLFYARNFNSTGCPERLSACRGIEGFRIGWGTLQYEDNVTNPEDMRPYCWHYPPKQCGIVPAGSVCGPVYCFTPSPVVVGTTDRLGVPTYTWGENETDVFLLNSTRPPVGSWFGCTWMNSTGFTKTCGAPPCRIRADFNASTDLLCPTDCFRKHPEATYIKCGSGPWLTPRCLVDYPYRLWHYPCTVNYSIFKIRMYVGGVEHRLTAACNFTRGDRCNLEDRDRSQLTPLLHSTTEWAILPCTYSDLPALSTGLLHLHQNIVDVQYMYGLSPALTKYVVRWEWVVLLFLLLADARVCACVWMLILLGQAEA

SEQ ID NO: 106 - protein, 750 aa, Hepatitis C virus
  misc_feature (458)..(458): Xaa can be any naturally occurring amino acid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPTDPRHRSRNVGKVIDTLTCGFADLMGYIPVVGAPLGGVARALAHGVRVLEDGVNYATGNLPGCSFSIFLLALLSCVTVPVSAVQVKNTSETYMVTNDCSNDSITWQLQAAVLHVPGCVPCERTGNTSRCWIPVSPNVAVQQPGALTQGLRTHIDMVVMSATLCSALYVGDLCGGVVLAAQLFIVSPRRHWFVQECNCSIYPGAITGHRMAWDMMMNWSPTTTMVLAYAMRVPEVIIDIISGAHWGVMFGLAYFSMQGAWAKVAVILLLTAGVEARTHTTGSVAGRTTSGFAGIFTSGPKQNIQLINTNGSWHINRTALNCNDSLNTGFMAALFYTKNFNSSGCPERLSXCRNIEAFRIGWGTLQYEDDVTNPEDMRPYCWHYPPKQCGIFPAGSVCGPVYCFTPSPVVVGTTNKLGVPTYTWGENETDVFILNSTRPPRGSWFGCTWMNSTGFTKTCGAPPCRIRADFNASTDLLCPTDCFRKHPEATYIKCGSGPWLTPRCLVDYPYRLWHYPCTVNYSIFKIRMYVGGVEHRLTAACNFSRGDRCNLEDRDRSQLTPLLHSTTEWAILPCSYSDLPALSTGLLHLHQNIVDVQYMYGLTPALTKYVVRWEWVVLLFLLLADARVCACLWMLILLGQAEA

SEQ ID NO: 107 - protein, 750 aa, Hepatitis C virus
MSTNPKPQRKTKRNTSRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPTDPRHRSRNVGKVIDTLTCGFADLMGYIPVVGAPLGGVARALAHGVRVLEDGVNYATGNLPGCSFSIFLLALLSCITVPVSAVQVKNISDSYMVTNDCSNDSITWQLQAAVLHVPGCVPCEKMGNISRCWIPVSPNVAVQRPGALTQGLRAHIDMVVMSATLCSALYVGDLCGGVMLAAQMFIVSPQHHHFVQECNCSIYPGAITGHRMAWDMMMNWSPTATMILAYAMRVPEVIIDIISGAHWGVMFGLAYFSMQGAWAKVVVILLLTAGVDAHTRSIAGSVAHATSGLAGLFTSGAKQNIQLINTNGSWHINRTALNCNDSLNTGFIASLFYTYRFNSSGCPERLSACRGIQAFRIGWGTLRYEDNVTNPEDMRPYCWHYPPKQCGIVSARSVCGPVYCFTPSPVVVGTTDRLGVPTYTWGENETDVFILNSTRPPGGSWFGCTWMNSTGFTKTCGAPPCRIRADFNASMDLLCPTDCFRKHPDATYIKCGSGPWLTPRCLVDYPYRLWHYPCTINYTIFKIRMYVGGVEHRLTAACNFTRGDPCNLEDRDRSQLSPLLHSTTEWAILPCSYSDLPALSTGLLHLHQNIVDVQYMYGLSPALTKYIVRWEWVVLLFLLLADARVCACLWMLILLGQAEA

SEQ ID NO: 108 - protein, 751 aa, Hepatitis C virus
MSTNPKPQRKTQRNTNRRPQDVKFPGGGQIVGGVYLLPRRGPRLGVRTARKTSERSQPRGRRQPIPKDRRSTGKSWGRPGYPWPLYGNEGLGWAGWLLSPRGSRPSWGPTDPRHRSRNVGKVIDTLTCGFADLMGYIPVVGAPLGGVARALAHGVRVLEDGVNYATGNLPGCSFSIFLLALLSCITIPASAVEVKNTSTGYMVTNDCANSSITWQLHAAVLHVPGCVPCERVDNNTSRCWIPVSPNIAVQRPGALTQGLRSHIDIVVMSATLCSALYVGDLCGGVMLAAQMFVVSPEHHWFVQECNCSIYPGTITGHRMAWDMMMNWSPTATMILAYAMRVPEVIIDIIGGAHWGVMFGLAYFSMQGAWAKVVVILLLAAGVDAYTHTVGGAAASTANSIAGLLSRGPRQNLQLINSNGSWHINRTALNCHDSLQTGFITALFYARHFNSSGCPERLAACRNIEAFRVGWGALQYEDNVTNPEDMRPYCWHYPPKQCGIVPARSVCGPVYCFTPSPVVVGTTDKLGVPTYTWGENETDVFLLNSTRPPQGPWFGCTWMNSTGFTKTCGAPPCRTRADFNASTDLLCPTDCFRKHPDATYNKCGSGPWLTPRCLIDYPYRLWHYPCTVNYTTFKIRMYVGGVEHRLMAACNFTRGDSCDLSQRDRGQLSPLLHSTTEWAILPCSFSDLPALSTGLLHLHQNIVDVQYMYGLSPALTKYIVRWEWVVLLFLLLADARVCACIWMLILLGQAEA

SEQ ID NO: 109 - protein, 750 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNTSRCWIPVSPNVAVQQPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIIGGAHWGVMFGLAYFSMQGAWAKVVVILLLAAGVDAQTHTVGGSTAHNARTLTGMFSLGARQKIQLINTNGSWHINRTALNCNDSLHTGFLASLFYTHSFNSSGCPERMSACRSIEAFRVGWGALQYEDNVTNPEDMRPYCWHYPPRQCGVVSASSVCGPVYCFTPSPVVVGTTDRLGAPTYTWGENETDVFLLNSTRPPQGSWFGCTWMNSTGYTKTCGAPPCRIRADFNASMDLLCPTDCFRKHPDTTYIKCGSGPWLTPRCLIDYPYRLWHYPCTVNYTIFKIRMYVGGVEHRLTAACNFTRGDRCNLEDRDRSQLSPLLHSTTEWAILPCTYSDLPALSTGLLHLHQNIVDVQFMYGLSPALTKYIVRWEWVVLLFLLLADARVCACLWMLILLGQAEA

SEQ ID NO: 110 - protein, 750 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEA

SEQ ID NO: 111 - protein, 750 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLSWSPTLTMILAYAARVPELVLEIIFGGHWGVVFGLAYFSMQGAWAKVIAILLLVAGVDATTYSSGQEAGRTVAGFAGLFTTGAKQNLYLINTNGSWHINRTALNCNDSLQTGFLASLFYTHKFNSSGCPERLSSCRGLDDFRIGWGTLEYETNVTNDGDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEA

SEQ ID NO: 112 - protein, 750 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPHWGPTDPRHRSRNLGKVIDTITCGFADLMGYIPVIGAPVGGVARALAHGVRVLEDGVNYATGNLPGCSFSIFLLALLSCVTVPVSAVEVRNISSSYYATNDCSNNSITWQLENAVLHLPGCVPCENDNGTLRCWTQVTPNVAVKHRGALTQNLRTHVDVIVVAATVCSALYVGDVCGAVMIASQALIVSPARHNFTQECNCSIYQGRITGHHMAWDMMLNWSPTITMILAYAARIPELVLEVIFGGHWGVMFGLAYFSMQGAWAKVIVILLLVAGVDARHHTTGLQAGKTLARVTSLFSIGAKQNIQLINTNGSWHINRTALNCNDSLQTGFIASLFYVNNINSSGCPERMSSCRELDDFRIGWGTLEYETNVTNDEDMRPYCWHYPPKPCGIVPARTVCGPVYCFTPSPIVVGTTDKQGVPTYSWGENETDVFLLNSTRPPRGSWFGCTWMNGTGFTKTCGAPPCRIRRDYNSTLDLLCPTDCFRKHPDTTYLKCGSGPWLTPKCLVEYPYRLWHYPCTVNFTIFKVRMYVGAVEHRFSAACNFTRGDRCRLEDRDRGQQSPLLHSTTEWAVLPCSFSDLPALSTGLLHLHQNIVDVQYLYGLSPAITRYIVKWEWVVLLFLLLADARVCACLWMLIILGQAEA

SEQ ID NO: 113 - protein, 750 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCCTVPVSAVEVRNISTSYYATNDCSNTSITWQLTNAVLHLPGCVPCENDNGTLRCWIQVTPNVAVKHRGALTHNLRTHVDVIVMAATVCSALYVGDICGAVMIVSQAFIISPERHNFTQECNCSMYQGHITGHRMAWDMMLNWSPTLTMILAYAARVPELVLEVIFGGHWGVVFGLAYFSMQGAWAKVIAILLLVAGVDANTYSSGVTVGHTTSTFANIFSVGPSQKINLINTNGSWHINRTALNCNDSLQTGFLASLFYVRNFNSSGCRERLSSCRRLDDFRIGWGTLEYETNVTNDEDMRPYCWHYPPKPCGIVSARTVCGPVYCFTPSPVVVGTTDRQGVPTYSWGENETDVFLLNSTRPPRGAWFGCTWMNGTGFTKTCGAPPCRIRRDYNSTLDLLCPTDCFRKHPDTTYLKCGAGPWLTPKCLVDYPYRLWHYPCTVNFTIFKVRMYVGGVEHRLSAACNFTRGDRCGLEDRDRGQQSPLLHSTTEWAVLPCSFSDLPALSTGLLHLHQNIVDVQYLYGLSPAITRYIVKWEWVVLLFLLLADARVCACLWMLIILGQAEA

SEQ ID NO: 114 - protein, 750 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPSDPRHRSRNLGRVIDTITCGFADLMGYIPVVGAPVGGVARALAHGVRVLEDGINYATRNLPGCSFSIFLLALLSCVTVPVSSVEIRNISTSYYATNDCSNNSITWQLTNAVLHLPGCVPCENDNGTLRCWIQVTPNVAVKHRGALTHNLRAHVDVIVMAATVCSALYVGDVCGAVMIVSQALIVSPERHNFTQECNCSIYQGHITGQRMAWDMMLNWSPTLTMILAYAARVPELVLEIVFGGHWGVVFGLAYFSMQGAWAKVIAILLLVAGVDATTYSTGATVGRTVGSFAGLFKLGAQQNVQLINTNGSWHINRTALNCNDSLHTGFMAALFYANKFNSSGCPERLSSCRGLDDFRIGWGTLEYETNVTNVEDMRPYCWHYPPKPCGIVPAQSVCGPVYCFTPSPVVVGTTDRQGVPTYNWGDNETDVFLLNSTRPPRGAWFGCTWMNGTGFTKTCGAPPCRIRKDFNSTLDLLCPTDCFRKHPDATYVKCGAGPWLTPRCLIDYPYRLWHYPCTVNFTIFKVRMYVGGVEHRFSAACNFTRGDRCRLEDRDRGQQSPLLHSTTEWAVLPCSFSDLPALSTGLLHLHQNIVDVQYLYGLSPAVTKYIVKWEWVVLLFLLLADARICACLWMLIILGQAEA

SEQ ID NO: 115 - protein, 750 aa, Hepatitis C virus
  misc_feature (203)..(203): Xaa can be any naturally occurring amino acid
  misc_feature (295)..(295): Xaa can be any naturally occurring amino acid
  misc_feature (343)..(343): Xaa can be any naturally occurring amino acid
  misc_feature (401)..(401): Xaa can be any naturally occurring amino acid
  misc_feature (426)..(426): Xaa can be any naturally occurring amino acid
  misc_feature (626)..(626): Xaa can be any naturally occurring amino acid
MSTDPKPQRKTKRNTNRRPQDVKFPGGGQIVGGVYLLPRRGPRLGVRAARKTSERSQPRGRRQPIPKDRRSPGKSWGKPGYPWPLYGNEGCGWAGWLLSPRGSRPTWGPTDPRHRSRNLGKVIDTITCGFADLMGYIPVVGAPVGGVARALAHGVRVLEDGINYATGNLPGCSFSIFLLALLSCLTVPASAVEVRNISSGYYXTNDCSNSSITWQLTNAVLHLPGCVPCENDNGTLRCWIQVTPNVAVKYRGALTHNLRTHVDMIVMAATVCSALYVGDVCGAVMIVSQAFIMSXERHNFTQECNCSIYQGHITGHRMAWDMMLGWSPTLTMILAYAARVPEXVLEVVFGGHWGVVFGLAYFSMQGAWAKVIAILLLVAGVDAGTYSSGATIGQGTRGLVXLFSAGPSQKISLINTNGSWHINRTXLNCNDSLQTGFIASLFYAKSFNSSGCPERLSSCRGLDDFRIGWGTLEYENNVTNDEDMRPYCWHYPPKPCGIVPARTVCGPVYCFTPSPVVVGTTDKQGVPTYSWGENETDVFLLNSTRPPQGAWFGCTWMNGTGFTKTCGAPPCRIRRDHTSTLDLLCPTDCFRKHPDTTYLKCGAGPWLTPKCLVDYPYRLWHYPCTXNFTIFKVRMYVGGVEHRFSAACNFTRGDRCRLEDRDRGQQSPLLHSTTEWAVLPCSFSDLPALSTGLLHLHQNIVDVQYLYGLSPAITKYIVKWEWVILLFLLLADARVCACLWMLIILGQAEA

SEQ ID NO: 116 - protein, 752 aa, hepatitis C virus
  misc_feature (431)..(431): Xaa can be any naturally occurring amino acid
  misc_feature (466)..(466): Xaa can be any naturally occurring amino acid
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCVPCVQDGNTSTCWTPVTPTVAVRYVGATTASIRSHVDLLVGAATMCSALYVGDMCGAVFLVGQAFTFRPRRHQTVQTCNCSLYPGHLSGHRMAWDMMMNWSPAVGMVVAHVLRLPQTLFDIIAGAHWGILAGLAYYSMQGNWAKVAIIMVMFSGVDATTYTTGGSAARGARGLTSLFSVGAKQKLQLVNTNGSWHINSTALNCNXSINTGFIAGLFYYHKFNSTGCPQRLSSCKPITFFXQGWGPLTDANITGPSDDKPYCWHYAPRPCDVVPASSVCGPVYCFTPSPVVVGTTDAKGVPTYTWGENETDVFLLESLRPPSGRWFGCTWMNSTGFVKTCGAPPCNIYGGGGNPHNESDLFCPTDCFRKHPEATYSRCGAGPWLTPRCMVDYPYRLWHYPCTVNFTLFKVRMFVGGFEHRFTAACNWTRGERCDIEDRDRSEQHPLLHSTTELAILPCSFTPMPALSTGLIHLHQNIVDVQYLYGVGSGMVGWALKWEFVILVFLLLADARVCVALWLMLMISQAEA

SEQ ID NO: 117 - protein, 752 aa, hepatitis C virus
MSTLPKPQRKTKRNTIRRPQDVKFPGGGQIVGGVYVLPRRGPRLGVRATRKTSERSQPRERRQPIPKARRSDGRSWAQPGYPWPLYGNEGCGWAGWLLSPRGSRPSWGPNDPRRRSRNLGKVIDTLTCGFADLMGYIPIVGAPVGGVARALAHGVRALEDGINFATGNLPGCSFSIFLLALLSCLIHPAASLEWRNTSGLYILTNDCPNSSIVYEADDVILHTPGCIPCVQDGNTSTCWTSVSPTVAVRYVGATTASIRSHVDLLVGAATLCSALYVGDMCGAVFLVGQAFTFRPRRHQTVQTCNCSLYPGHLTGHRMAWDMMMNWSPAVGMVVAHVLRMPQTVFDIIAGAHWGILAGLAYYSMQGNWAKVAIIMVMFSGVDAETHTTGGTAARNAFTLTGLFTQGARQKLELINTNGSWHINRTALNCNESLNTGFIAGLFYLHKFNSTGCPERLSSCKPITFFRQGWGSLTDANITGPSDDKPYCWHYAPRPCEVVPALNVCGPVYCFTPSPVVVGTTDRQGVPTYTWGENETDVFLLRSLRPPSGQWFGCTWMNSTGFVKTCGAPPCDIYGGGGNRCNESDLFCPTDCFRKHPEATYSRCGAGPWLTPRCLVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSGVVGWALRWEFVVLVFLLLADARVCVALWLMLMISQAEA

SEQ ID NO: 118 - protein, 752 aa, hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLVHPAASLEWRNTSGLYVLTNDCSNSSIVYEADDVILHTPGCVPCVQDDNTSTCWTPVTPTVAVRYVGATTASIRSHVDLLVGAATLCSALYVGDMCGAVFLVGQAFTFRPRRHQTVQTCNCSLYPGHVSGHRMAWDMMMNWSPAVGMVVAHILRLPQTLFDILAGAHWGILAGLAYYSMQGNWAKVAIVMIMFSGVDAETYVTGGSVAHSARGLTSLFSMGAKQKLQLVNTNGSWHINSTALNCNESINTGFIAGLFYYHKFNSTGCPQRLSSCKPIISFRQGWGPLTDANITGPSDDRPYCWHYAPRPCSVVPASSVCGPVYCFTPSPVVVGTTDIKGKPTYNWGENETDVFLLESLRPPSGRWFGCAWMNSTGFLKTCGAPPCNIYGGEGDPENETDLFCPTDCFRKHPEATYSRCGAGPWLTPRCMVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSDMVGWALKWEFVILVFLLLADARVCVALWLMLMVSQAEA

SEQ ID NO: 119 - protein, 752 aa, hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCVPCVQDGNTSTCWTPVTPTVAVRYVGATTASIRSHVDLLVGAATMCSALYVGDMCGAVFLVGQAFTFRPRRHQTVQTCNCSLYPGHLSGHRMAWDMMMNWSPAVGMVVAHVLRLPQTLFDIMAGAHWGILAGLAYYSMQGNWAKVAIIMVMFSGVDAHTYTTGGTASRHTQAFAGLFDIGPQQKLQLVNTNGSWHINSTALNCNESINTGFIAGLFYYHKFNSTGCPQRLSSCKPITFFRQGWGPLTDANITGPSDDRPYCWHYAPRPCDIVPASSVCGPVYCFTPSPVVVGTTDARGVPTYTWGENEKDVFLLKSQRPPSGRWFGCSWMNSTGFLKTCGAPPCNIYGGEGNPHNESDLFCPTDCFRKHPETTYSRCGAGPWLTPRCMVDYPYRLWHYPCTVDFRLFKVRMFVGGFEHRFTAACNWTRGERCDIEDRDRSEQHPLLHSTTELAILPCSFTPMPALSTGLIHLHQNIVDVQYLYGVGSGMVGWALKWEFVILVFLLLADARVCVALWLMLMISQTEA

SEQ ID NO: 120 - protein, 752 aa, hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGQNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCVPCVQDGNTSTCWTPVTPTVAVRYVGATTASIRSHVDLLVGAATMCSALYVGDMCGAVFLVGQAFTFRPRRHQTVQTCNCSLYPGHLSGHRMAWDMMMNWSPAVGMVVSHVLRLPQTLFDIIAGAHWGILAGLAYYSMQGNWAKVAVIMVMFSGVDAETYITGGSAAHGVSTLTSLFSSGPQQKLQLVKTNGSWHINSTALNCNESINTGFIAGLFYYHKFNSTGCPQRLSSCKPITFFRQGWGSLTDANVTGASADKPYCWHYAPRPCDVVPALNVCGPVYCFTPSPVVVGTTDRKGVPTYNWGENESDVFLLESLRPPSGRWFGCAWMNSTGFLKTCGAPPCNIYGGGGNPNNESHLFCPTDCFRKHPDATYSRCGAGPWLTPRCMVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSGMVGWALKWEFVILIFLLLADARVCVALWLMLMISQAEA

SEQ ID NO: 121 - protein, 752 aa, hepatitis C virus
MSTLPKPQRKTKRNTIRRPQDVKFPGGGQIVGGVYVLPRRGPRLGVCATRKTSERSQPRRRRQPIPKARQSGGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCVPCVQNDNISTCWTPVTPTVAVRYVGATTASIRSHVDLLVGAATMCSALYVGDMCGAVFLVGQAFTFRPRRHQTVQTCNCSLYPGHLSGHRMAWDMMMNWFPALGMAVAHVLRVPQTLFDIIAGAHWGILAGLAYYSMQGNWAKVAIIMVMFSGVDAVTYTTGGSAAHATRGLTSLFSVGAQQKLQLVNTNGSWHINSTALNCNESINTGFIAGLFYYHRFNSTGCPQRLSSCKPITFFKQGWGPLTDANISGPSDDKPYCWHYAPRPCKVVPASGVCGPVYCFTPSPVVVGTTDAKGVPTYTWGANDTDVFLLESLRPPGGRWFGCTWMNSTGFVKTCGASPCDIYGGGGNSGNESDLFCPTDCFRKHPEATYSRCGAGPWLTPRCMVDYPYRLWHYPCTVNFTLFKVRMFVGGFEHRFTAACNWTRGERCDIEDRDRSEQHPLLHSTTELAILPCSFTPMPALSTGLIHLHQNIVDVQYLYGVGSGMVGWALKWEFVILIFLLLADRRVCVALWLMLMITQAEA

SEQ ID NO: 122 - protein, 752 aa, hepatitis C virus
MSTLPKPQRKTKRNTVCRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNVSGLYILTNDCPNSSIVYEADDVILHTPGCIPCVQDGNTSTCWTALTPTVAVRYVGATTASIRSHVDLLVGAATMCSALYVGDMCGAVFLVGQAFTFRPRRHQTVQTCNCSLYPGHLTGHRMAWDMMMNWSPAVGMVVAHVLRLPQTLFDIIAGAHWGILAGLAYYSMQGNWAKVIIIMVMFSGVDATTHVTGGTAGLTAFRLTGLFTVGPQQKLQLVNTNGSWHINRTALNCNDSLNTGFIAGLFRFHKFNSTGCPEMLSSCKPITSFKQGWGPLTDANITIPSDDRPYCWHYPPRSCEVVPALSVCGPVYCFTPSPVVVGTTDAKGVPTYTWGENETDVFLLKSLRPPGGRWFGCTWMNSTGFVQTCGAPPCNIYGGGGDLKNESDLFCPTDCFRKHPEATYSRCGAGPWLTPRCMVDYPYRLWHYPCTVNFTLFKVRMFVGGFEHRFTAACNWTRGERCDIEDRDRSELHPLLHSTTELAILPCSFTPMPALSTGLIHLHQNIVDVQYLYGVGSGMVGWAVKWEFVILVFLLLADARVCVALWLMLMISQAEA

SEQ ID NO: 123 - protein, 752 aa, hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLQWRNTSGLYVLTNDCSNSSIVYEADDVILHTPGCVPCVQDGNTSTCWTPVTPTVAVRYVGATTASIRSHVDLLVGAATMCSALYVGDMCGAVFLVGQAFTFRPRRHQTVQTCNCSLYPGHLSGHRMAWDMMMNWSPAAGMVVAHILRLPQTLFDIIAGAHWGILAGLAYYSMQGNWAKVAIIMVMFSGVDATTYTSGGSVAQQARGLADLFSVGAKQNLQLVNTNGSWHINSTALNCDDSINTGFIAGLFYYHKFNSTGCPQRLSDCKPITFFKQGWGPLTDANITGPSDDKPYCWHYAPRRCGVVPASSVCGPVYCFTPSPVVVGTTDAKGVPTYTWGANETDVFLLESLRPPSGRWFGCAWMNSTGFLKTCGAPPCNIYGGGGNPHNESDLFCPTDCFRKHPEATYSRCGAGPWLTPRCMVDYPYRLWHYPCTVNFTLFKMRTFVGGFEHRFTAACNWTRGERCDIEDRDRSEQHPLLHSTTELAILPCSFTPMPALSTGLIHLHQNIVDVQYLYGVGSGMVGWALKWEFVILVFLLLADARVCVALWLMLMISQAEA

SEQ ID NO: 124 - protein, 752 aa, hepatitis C virus; identical to SEQ ID NO: 123

SEQ ID NO: 125 - protein, 752 aa, hepatitis C virus
MSTLPKPQRKTKRNTIRRPQDVKFPGGGQIVGGVYVLPRRGPRLGVCATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLVHPAASLEWRNTSGLYVLTNDCPNSSIVYEADDVILHTPGCIPCVQDGNKSTCWTSVTPTVAVKYVGATTASIRSHVDLLVGAATMCSALYVGDMCGAVFLVGQAFTFRPRRHQTVQTCNCSLYPGHLSGHRMAWDMMMNWSPAVGMVVAHVLRLPQTLFDIIAGAHWGILAGLAYYSMQGNWAKVAIIMVMFSGVDATTYTTGGNAARGASGIVSLFTPGAKQNLQLVNTNGSWHINRTALNCNDSINTGFIAGLIYYHKFNSTGCPQRLSSCKPITFFRQGWGSLTDANITGPSDDKPYCWHYPPRPCDTIRASSVCGPVYCFTPSPVVVGTTDAKGAPTYNWGANETDMFLLQSLRPPSGRWFGCTWMNSTGFTKTCGAPPCNIYGGGGNLNNESDLFCPTDCFRKHPEATYSRCGAGPWLTPRCLVDYPYRLWHYPCTVNFTLFRMRTFVGGFEHRFTAACNWTRGERCNIEDRDRSEQHPLLHSTTELAILPCSFTPMPALSTGLIHLHQNIVDVQYLYGIGSGVVGWALKWEFVILVFLLLADARVCVALWLMLMISQAEA

SEQ ID NO: 126 - protein, 752 aa, hepatitis C virus
MSTLPKPQRKTKRNTIRRPQDVKFPGGGVIYVGVYVLPRRGPRLGVRATRKTSERSQPRGRRKPIPKARRSEGRSWAQPGYPWPLYGNEGCGWAGWLLSPRGSRPNWAPNDPRRRSRNLGKVIDTLTCGFADLMGYIPLVGAPLGGAARALAHGVRALEDGINFATGNLPGCSFSIFLLALFSCLIHPAASLEWRNTSGLYVLTNDCSNSSIVYEADDVILHTPGCIPCVQDGNTSTCWTPVTPTVAVRYVGATTASIRSHVDLLVGAGTMCSALYVGDMCGPVFLVGQAFTFRPRRHRTVQTCNCSLYPGHLSGQRMAWDMMMNWSPAVGMVVAHILRLPQTLFDVVAGAHWGIIAGLAYYSMQGNWAKVAIIMVMFSGVDASTHVTAGQAARNAYGITSLFSVGAKQNLQLINTNGSWHINRTALNCNESINTGFIAGLFYYHKFNSTGCPQRLSSCKPITFFKQGWGPLTDANITGPSDDKPYCWHYAPRPCGIVPALNVCGPVYCFTPSPVVVGTTDAKGAPTYTWGANKTDVFLLESLRPPSGRWFGCTWMNSTGFVKTCGAPPCNIYGDGRDAQNESDLFCPTDCFRKHPEATYSRCGAGPWLTPRCLVDYPYRLWHYPCTVNFTLFKVRMFVGGFEHRFTAACNWTRGERCDIEDRDRSEQHPLLHSTTELAILPCSFTPMPALSTGLIHLHQNIVDVQYLYGIGSGMVGWALKWEFVILIFLLLADARVCVALWLILTISQAEA

SEQ ID NO: 127 - protein, 754 aa, hepatitis C virus
MSTLPKPKRQTKRNTLRRPKNVKFPAGGQIVGEVYVLPRRGPQLGVREVRKTSERSQPRGRRQPTPKARPREGRSWAQPGYPWPLYGNEGCGWAGWLLPPRGSRPSWGQNDPRRRSRNLGKVIDTLTCGFADLMGYIPLIGAPVGGVARALAHGVRALEDGVNYATGNLPGCSFSIFLLALFSCLTCPASSLEYRNASGLYLLTNDCSNRSIVYEADDVILHLPGCVPCVETDNNNTSCWTPISPTVAVKHPGVTTASIRNHVNMLVAPPTLCSALYVEDAFGAVSLVGQAFTFRPRQHKTVQTCNCSIYPGHVSGHRMAWDMMMNWSPAIGLVISHLMRLPQTFFDLVVGAHWGVMAGLAYFSMQGNWAKVVIVLIMFSGVDATTHTTGGSAAQATAGFTSFFTRGPSQNLQLVNSNGSWHINSTALNCNDSLNTGFIAGLFYYHKFNSSGCPERMSSCKPITYFNQGWGPLTDANINGPSEDRPYCWHYPPRPCNITKPLNVCGPVYCFTPSPVVVGTTDIKGLPTYRFGVNESDVFLLTSLRPPQGRWFGCVWMNSTGFVKTCGAPPCNIYGGMKDIEANQTHLKCPTDCFRKHHDATFTRCGSGPWLTPRCLVDYPYRLWHYPCTVNFSIFKVRMFVGGHEHRFSAACNWTRGERCDLEDRDRSEQQPLLHSTTDSLILPCSFTPMRRLSTGLIHLHQNIVDVQYLYGVGSAVVGWALKWEFVVLVFLLLADARVCVALWMMLLISQAEA

SEQ ID NO: 128 - protein, 751 aa, hepatitis C virus
MSTLPKPQRITKRNINRRPQDVKFPGGGQIVGGVYVLPRRGPKLGVRAVRKTSERSQPRSRRQPIPRARRTEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALLSCLLTPTAGLEYRNASGLYTVTNDCSNGSIVYEAGDVILHLPGCIPCVRLNNASKCWTPVSPTVAVSRPGAATASLRTHVDMMVGAATLCSALYVGDLCGALFLVGQGFSWRHRQHWTVQDCNCSIYPGHLTGHRMAWDMMMNWSPAMTLIVSQVLRLPQTMFDLVIGAHWGVMAGVAYYSMQGNWAKVFLVLCLFSGVDASTTITGGVAASGAFTITSLFSTGAKQPLHLVNTNGSWHINRTALNCNDSLNTGFIAGLLYYHKFNSSGCVERMSACSPLDRFAQGWGPLGPANISGPSSEKPYCWHYAPRPCDTVPAQSVCGPVYCFTPSPVVVGATDKRGAPTYTWGENESDVFLLESARPPTEPWFGCTWMNGSGYVKTCGAPPCHIYGGREGKSNNSLVCPTDCFRKHPDATYNRCGAGPWLTPRCLVDYPYRLWHYPCTVNYTIFKVRMFVGGLEHRFNAACNWTRGERCNLEDRDRSEMYPLLHSTTEQAILPCSFVPIPALSTGLIHLHQNIVDVQYLYGISSGLVGWAIKWEFVILIFLLLADARVCVVLWMMMLISQAEA

SEQ ID NO: 129 - protein, 750 aa, hepatitis C virus
MSTNPKPQRLTKRNTVRRPQNVKFPGGGQIVGGVYLLPRRGPRLGVRGTRKSSERSQPRGRRQRIPKAASSQGKAWGKPGYPWPLYGNEGCGWAGWLLSPRGSRPTWGPTDPRHRSRNLGKVIDTMTCGFADLMGYIPVLGAPLGGVARALAHGVRVLEDGVNYATGNLPGCSFSIFLLALLSCLTVPASAYEVRNSSGVYHLTNDCPNASIVYETDNAILHEPGCVPCVREGNTSRCWEPVAPTLAVRYRGALTDDLRTHIDLVVASATLCSALYVGDICGAIFIASQAVLWKPGGGRIVQDCNCSIYPGHVTGHRMAWDMMQNWAPALSMVAAYAVRVPGVIITTVAGGHWGVLFGLAYFGMAGNWAKVILIMLLMSGVDAETMAVGARAAHTTGALVSLLNPGPSQRLQLINTNGSWHINRTALNCNDSLQTGFIAALFYTHRFNSSGCPERMASCKPLSDFDQGWGPLWYNSTERPSDQRPYCWHYAPSPCGIVPAKDVCGPVYCFTPSPVVVGTTDRRGVPTYTWGENESDVFLLNSTRPPQGSWFGCSWMNTTGFTKTCGGPPCKIRPQGAQSNTSLTCPTDCFRKHPRATYSACGSGPWLTPRCMVHYPYRLWHYPCTVNFTIHKVRLYIGGVEHRLDAACNWTRGERCDLEDRDRVDMSPLLHSTTELAILPCSFVPLPALSTGLIHLHQNIVDAQYLYGLSPAIISWAIRWEWVVLVFLLLADARICACLWMMMLMAQAEA

SEQ ID NO: 130 - protein, 659 aa, hepatitis C virus
MDAMKRGLCCVLLLCGAVFVSPSYQVRNSTGLYHVTNDCPNSSIVYEAADAILHTPGCVPCVREGNTSRCWVAMTPTVATRDGKLPTTQLRRHIDLLVGSATLCSALYVGDLCGSIFLVGQMFTFSPRRHWTTQDCNCSLYPGHITGHRMAWDMMMNWSPTAALITAQLLRIPQAILDMIAGAHWGVLAGIAYFSMVGNWAKVLVVLLLFAGVDAQTDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKLEVLFQGPQTHVTGGRAAHITAGLTSLFSPGPSQKLQLVNTNGSWHINSTALNCNDSLKTGWIAGLLYSYKFNSSGCPERLASCRRLTDFAQGWGPISHANGSGPDERPYCWHYPPRPCGIVPAKSVCGPVYCFTPSPVVVGTTDKSGAPTYNWGENDWDVFVLNNTRPPLGNWFGCTWMNSTGFTKVCGAPPCVIGGAGNNTLRCPTDCFRKHP

SEQ ID NO: 131 - protein, 688 aa, hepatitis C virus
MDAMKRGLCCVLLLCGAVFVSPSYQVRNSTGLYHVTNDCPNSSIVYEAADAILHTPGCVPCVREGNTSRCWVAMTPTVATRDGKLPTTQLRRHIDLLVGSATLCSALYVGDLCGSIFLVGQMFTFSPRRHWTTQDCNCSLYPGHITGHRMAWDMMMNWSPTAALITAQLLRIPQAILDMIAGAHWGVLAGIAYFSMVGNWAKVLVVLLLFAGVDAQTDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKLEVLFQGPAIPLEVIKGGRHLIFCHSKKKCDELAAKLQTHVTGGRAAHITAGLTSLFSPGPSQKLQLVNTNGSWHINSTALNCNDSLKTGWIAGLLYSYKFNSSGCPERLASCRRLTDFAQGWGPISHANGSGPDERPYCWHYPPRPCGIVPAKSVCGPVYCFTPSPVVVGTTDKSGAPTYNWGENDWDVFVLNNTRPPLGNWFGCTWMNSTGFTKVCGAPPCVIGGAGNNTLRCPTDCFRKHP

SEQ ID NO: 132 - protein, 866 aa, hepatitis C virus
MDAMKRGLCCVLLLCGAVFVSPSYQVRNSTGLYHVTNDCPNSSIVYEAADAILHTPGCVPCVREGNTSRCWVAMTPTVATRDGKLPTTQLRRHIDLLVGSATLCSALYVGDLCGSIFLVGQMFTFSPRRHWTTQDCNCSLYPGHITGHRMAWDMMMNWSPTAALITAQLLRIPQAILDMIAGAHWGVLAGIAYFSMVGNWAKVLVVLLLFAGVDAQTDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKLEVLFQGPAIPLEVIKGGRHLIFCHSKKKCDELAAKLVALGINAVAYYRGLDVSVIPTSQTHVTGGRAAHITAGLTSLFSPGPSQKLQLVNTNGSWHINSTALNCNDSLKTGWIAGLLYSYKFNSSGCPERLASCRRLTDFAQGWGPISHANGSGPDERPYCWHYPPRPCGIVPAKSVCGPVYCFTPSPVVVGTTDKSGAPTYNWGENDWDVFVLNNTRPPLGNWFGCTWMNSTGFTKVCGAPPCVIGGAGNNTLRCPTDCFRKHPDATYSRCGSGPWITPRCLVDYPYRLWHYPCTVNYSIFKIRMYLGGVEHRLEAACNWTRGERCDLEDRDRSELSPLLLSTTQWQVLPCSFTTLPALSTGLIHLHQNIVDVQYLYGVGSSVASWAIKWDYVVLLFLLLADARICSCLWMMLLISQAEA

SEQ ID NO: 133 - protein, 915 aa, hepatitis C virus
MDAMKRGLCCVLLLCGAVFVSPSYQVRNSTGLYHVTNDCPNSSIVYEAADAILHTPGCVPCVREGNTSRCWVAMTPTVATRDGKLPTTQLRRHIDLLVGSATLCSALYVGDLCGSIFLVGQMFTFSPRRHWTTQDCNCSLYPGHITGHRMAWDMMMNWSPTAALITAQLLRIPQAILDMIAGAHWGVLAGIAYFSMVGNWAKVLVVLLLFAGVDAQTDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKLEVLFQGPVALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDFQTHVTGGRAAHITAGLTSLFSPGPSQKLQLVNTNGSWHINSTALNCNDSLKTGWIAGLLYSYKFNSSGCPERLASCRRLTDFAQGWGPISHANGSGPDERPYCWHYPPRPCGIVPAKSVCGPVYCFTPSPVVVGTTDKSGAPTYNWGENDWDVFVLNNTRPPLGNWFGCTWMNSTGFTKVCGAPPCVIGGAGNNTLRCPTDCFRKHPDATYSRCGSGPWITPRCLVDYPYRLWHYPCTVNYSIFKIRMYLGGVEHRLEAACNWTRGERCDLEDRDRSELSPLLLSTTQWQVLPCSFTTLPALSTGLIHLHQNIVDVQYLYGVGSSVASWAIKWDYVVLLFLLLADARICSCLWMMLLISQAEA

SEQ ID NO: 134 - protein, 659 aa, hepatitis C virus
MDAMKRGLCCVLLLCGAVFVSPSYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKLEVLFQGPETHVTGGSAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHP

SEQ ID NO: 135 - protein, 688 aa, hepatitis C virus
MDAMKRGLCCVLLLCGAVFVSPSYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKLEVLFQGPAIPLEVIKGGRHLIFCHSKKKCDELAAKLETHVTGGSAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHP

SEQ ID NO: 136 - protein, 866 aa, hepatitis C virus
MDAMKRGLCCVLLLCGAVFVSPSYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKLEVLFQGPAIPLEVIKGGRHLIFCHSKKKCDELAAKLVALGINAVAYYRGLDVSVIPTSETHVTGGSAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEA

SEQ ID NO: 137 - protein, 915 aa, hepatitis C virus
MDAMKRGLCCVLLLCGAVFVSPSYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKLEVLFQGPVALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDFETHVTGGSAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEA

SEQ ID NO: 138 - protein, 653 aa, hepatitis C virus
MDAMKRGLCCVLLLCGAVFVSPSLEWRNTSGLYVLTNDCSNSSIVYEADDVILHTPGCVPCVQDDNTSTCWTPVTPTVAVRYVGATTASIRSHVDLLVGAATLCSALYVGDMCGAVFLVGQAFTFRPRRHQTVQTCNCSLYPGHVSGHRMAWDMMMNWSPAVGMVVAHILRLPQTLFDILAGAHWGILAGLAYYSMQGNWAKVAIVMIMFSGVDAETDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKLEVLFQGPETYVTGGSVAHSARGLTSLFSMGAKQKLQLVNTNGSWHINSTALNCNESINTGFIAGLFYYHKFNSTGCPQRLSSCKPIISFRQGWGPLTDANITGPSDDRPYCWHYAPRPCSVVPASSVCGPVYCFTPSPVVVGTTDIKGKPTYNWGENETDVFLLESLRPPSGRWFGCAWMNSTGFLKTCGAPPCNIYGGEGDPENETD

SEQ ID NO: 139 - protein, 682 aa, hepatitis C virus
MDAMKRGLCCVLLLCGAVFVSPSLEWRNTSGLYVLTNDCSNSSIVYEADDVILHTPGCVPCVQDDNTSTCWTPVTPTVAVRYVGATTASIRSHVDLLVGAATLCSALYVGDMCGAVFLVGQAFTFRPRRHQTVQTCNCSLYPGHVSGHRMAWDMMMNWSPAVGMVVAHILRLPQTLFDILAGAHWGILAGLAYYSMQGNWAKVAIVMIMFSGVDAETDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKLEVLFQGPAIPLEVIKGGRHLIFCHSKKKCDELAAKLETYVTGGSVAHSARGLTSLFSMGAKQKLQLVNTNGSWHINSTALNCNESINTGFIAGLFYYHKFNSTGCPQRLSSCKPIISFRQGWGPLTDANITGPSDDRPYCWHYAPRPCSVVPASSVCGPVYCFTPSPVVVGTTDIKGKPTYNWGENETDVFLLESLRPPSGRWFGCAWMNSTGFLKTCGAPPCNIYGGEGDPENETD

SEQ ID NO: 140 - protein, 872 aa, hepatitis C virus
MDAMKRGLCCVLLLCGAVFVSPSLEWRNTSGLYVLTNDCSNSSIVYEADDVILHTPGCVPCVQDDNTSTCWTPVTPTVAVRYVGATTASIRSHVDLLVGAATLCSALYVGDMCGAVFLVGQAFTFRPRRHQTVQTCNCSLYPGHVSGHRMAWDMMMNWSPAVGMVVAHILRLPQTLFDILAGAHWGILAGLAYYSMQGNWAKVAIVMIMFSGVDAETDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKLEVLFQGPAIPLEVIKGGRHLIFCHSKKKCDELAAKLVALGINAVAYYRGLDVSVIPTSETYVTGGSVAHSARGLTSLFSMGAKQKLQLVNTNGSWHINSTALNCNESINTGFIAGLFYYHKFNSTGCPQRLSSCKPIISFRQGWGPLTDANITGPSDDRPYCWHYAPRPCSVVPASSVCGPVYCFTPSPVVVGTTDIKGKPTYNWGENETDVFLLESLRPPSGRWFGCAWMNSTGFLKTCGAPPCNIYGGEGDPENETDLFCPTDCFRKHPEATYSRCGAGPWLTPRCMVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSDMVGWALKWEFVILVFLLLADARVCVALWLMLMVSQAEA

SEQ ID NO: 141 - protein, 921 aa, hepatitis C virus
MDAMKRGLCCVLLLCGAVFVSPSLEWRNTSGLYVLTNDCSNSSIVYEADDVILHTPGCVPCVQDDNTSTCWTPVTPTVAVRYVGATTASIRSHVDLLVGAATLCSALYVGDMCGAVFLVGQAFTFRPRRHQTVQTCNCSLYPGHVSGHRMAWDMMMNWSPAVGMVVAHILRLPQTLFDILAGAHWGILAGLAYYSMQGNWAKVAIVMIMFSGVDAETDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKLEVLFQGPVALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDFETYVTGGSVAHSARGLTSLFSMGAKQKLQLVNTNGSWHINSTALNCNESINTGFIAGLFYYHKFNSTGCPQRLSSCKPIISFRQGWGPLTDANITGPSDDRPYCWHYAPRPCSVVPASSVCGPVYCFTPSPVVVGTTDIKGKPTYNWGENETDVFLLESLRPPSGRWFGCAWMNSTGFLKTCGAPPCNIYGGEGDPENETDLFCPTDCFRKHPEATYSRCGAGPWLTPRCMVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSDMVGWALKWEFVILVFLLLADARVCVALWLMLMVSQAEA

SEQ ID NO: 142 - protein, 653 aa, hepatitis C virus
MDAMKRGLCCVLLLCGAVFVSPSLEWRNTSGLYILTNDCPNSSIVYEADDVILHTPGCIPCVQDGNTSTCWTSVSPTVAVRYVGATTASIRSHVDLLVGAATLCSALYVGDMCGAVFLVGQAFTFRPRRHQTVQTCNCSLYPGHLTGHRMAWDMMMNWSPAVGMVVAHVLRMPQTVFDIIAGAHWGILAGLAYYSMQGNWAKVAIIMVMFSGVDAETDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKLEVLFQGPETHTTGGTAARNAFTLTGLFTQGARQKLELINTNGSWHINRTALNCNESLNTGFIAGLFYLHKFNSTGCPERLSSCKPITFFRQGWGSLTDANITGPSDDKPYCWHYAPRPCEVVPALNVCGPVYCFTPSPVVVGTTDRQGVPTYTWGENETDVFLLRSLRPPSGQWFGCTWMNSTGFVKTCGAPPCDIYGGGGNRCNESD

SEQ ID NO: 143 - protein, 682 aa, hepatitis C virus
MDAMKRGLCCVLLLCGAVFVSPSLEWRNTSGLYILTNDCPNSSIVYEADDVILHTPGCIPCVQDGNTSTCWTSVSPTVAVRYVGATTASIRSHVDLLVGAATLCSALYVGDMCGAVFLVGQAFTFRPRRHQTVQTCNCSLYPGHLTGHRMAWDMMMNWSPAVGMVVAHVLRMPQTVFDIIAGAHWGILAGLAYYSMQGNWAKVAIIMVMFSGVDAETDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKLEVLFQGPAIPLEVIKGGRHLIFCHSKKKCDELAAKLETHTTGGTAARNAFTLTGLFTQGARQKLELINTNGSWHINRTALNCNESLNTGFIAGLFYLHKFNSTGCPERLSSCKPITFFRQGWGSLTDANITGPSDDKPYCWHYAPRPCEVVPALNVCGPVYCFTPSPVVVGTTDRQGVPTYTWGENETDVFLLRSLRPPSGQWFGCTWMNSTGFVKTCGAPPCDIYGGGGNRCNESD

SEQ ID NO: 144 - protein, 873 aa, hepatitis C virus
MDAMKRGLCCVLLLCGAVFVSPSLEWRNTSGLYILTNDCPNSSIVYEADDVILHTPGCIPCVQDGNTSTCWTSVSPTVAVRYVGATTASIRSHVDLLVGAATLCSALYVGDMCGAVFLVGQAFTFRPRRHQTVQTCNCSLYPGHLTGHRMAWDMMMNWSPAVGMVVAHVLRMPQTVFDIIAGAHWGILAGLAYYSMQGNWAKVAIIMVMFSGVDAETDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKLEVLFQGPAIPLEVIKGGRHLIFCHSKKKCDELAAKLVALGINAVAYYRGLDVSVIPTSGETHTTGGTAARNAFTLTGLFTQGARQKLELINTNGSWHINRTALNCNESLNTGFIAGLFYLHKFNSTGCPERLSSCKPITFFRQGWGSLTDANITGPSDDKPYCWHYAPRPCEVVPALNVCGPVYCFTPSPVVVGTTDRQGVPTYTWGENETDVFLLRSLRPPSGQWFGCTWMNSTGFVKTCGAPPCDIYGGGGNRCNESDLFCPTDCFRKHPEATYSRCGAGPWLTPRCLVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSGVVGWALRWEFVVLVFLLLADARVCVALWLMLMISQAEA

SEQ ID NO: 145 - protein, 921 aa, hepatitis C virus
MDAMKRGLCCVLLLCGAVFVSPSLEWRNTSGLYILTNDCPNSSIVYEADDVILHTPGCIPCVQDGNTSTCWTSVSPTVAVRYVGATTASIRSHVDLLVGAATLCSALYVGDMCGAVFLVGQAFTFRPRRHQTVQTCNCSLYPGHLTGHRMAWDMMMNWSPAVGMVVAHVLRMPQTVFDIIAGAHWGILAGLAYYSMQGNWAKVAIIMVMFSGVDAETDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKLEVLFQGPVALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDFETHTTGGTAARNAFTLTGLFTQGARQKLELINTNGSWHINRTALNCNESLNTGFIAGLFYLHKFNSTGCPERLSSCKPITFFRQGWGSLTDANITGPSDDKPYCWHYAPRPCEVVPALNVCGPVYCFTPSPVVVGTTDRQGVPTYTWGENETDVFLLRSLRPPSGQWFGCTWMNSTGFVKTCGAPPCDIYGGGGNRCNESDLFCPTDCFRKHPEATYSRCGAGPWLTPRCLVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSGVVGWALRWEFVVLVFLLLADARVCVALWLMLMISQAEA

SEQ ID NO: 146 - protein, 227 aa, Homo sapiens
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 147 - protein, 325 aa, Homo sapiens
STKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 148 - protein, 246 aa, Homo sapiens
HKPSNTKVDKRVELKTPLGDTTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 149 - protein, 383 aa, Homo sapiens
PTKAPDVFPIISGCRHPKDNSPVVLACLITGYHPTSVTVTWYMGTQSQPQRTFPEIQRRDSYYMTSSQLSTPLQQWRQGEYKCVVQHTASKSKKEIFRWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPRSTTFWAWSVLRVPAPPSPQPATYTCVVSHEDSRTLLNASRSLEVSYVTDHGPMK

SEQ ID NO: 150 - protein, 276 aa, Homo sapiens
VTSTLTIKZSDWLGESMFTCRVDHRGLTFQQNASSMCVPDQDTAIRVFAIPPSFASIFLTKSTKLTCLVTDLTTYBSVTISWTREENGAVKTHTNISESHPNATFSAVGEASICEDBDWSGERFTCTVTHTDLPSPLKQTISRPKGVALHRPBVYLLPPARZZLNLRESATITCLVTGFSPADVFVEWMQRGEPLSPQKYVTSAPMPEPQAPGRYFAHSILTVSEEEWNTGGTYTCVVAHEALPNRVTERTVDKSTGKPTLYNVSLVMSDTAGTCY

SEQ ID NO: 151 - protein, 353 aa, Homo sapiens
ASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPSCCHPRLSLHRPALEDLLLGSEANLTCTLTGLRDASGVTFTWTPSSGKSAVQGPPERDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 152 - protein, 222 aa, Homo sapiens
ADPCDSNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGK

SEQ ID NO: 153 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 154 - protein, 15 aa, Artificial sequence
  synthetic amino acid sequence
VLVLNPSVAATLGFG

SEQ ID NO: 155 - protein, 15 aa, Artificial sequence
  synthetic amino acid sequence
TYGKFLADGGCSGGA

SEQ ID NO: 156 - protein, 15 aa, Artificial sequence
  synthetic amino acid sequence
GGRHLIFCHSKKKCD

SEQ ID NO: 157 - protein, 11 aa, Artificial sequence
  synthetic amino acid sequence
VAYYRGLDVSV

SEQ ID NO: 158 - protein, 18 aa, Artificial sequence
  synthetic amino acid sequence
ATDALMTGFTGDFDSVID

SEQ ID NO: 159 - protein, 15 aa, Artificial sequence
  synthetic amino acid sequence
TGLTHIDAHFLSQTK

SEQ ID NO: 160 - protein, 13 aa, Artificial sequence
  synthetic amino acid sequence
QYLAGLSTLPGNP

SEQ ID NO: 161 - protein, 8 aa, Artificial sequence
  synthetic amino acid sequence
NLLPAILS

SEQ ID NO: 162 - protein, 27 aa, Artificial sequence
  synthetic amino acid sequence
RHVGPGEGAVQWMNRLIAFASRGNHVS

SEQ ID NO: 163 - protein, 15 aa, Artificial sequence
  synthetic amino acid sequence
SSASQLSAPSLKATC

SEQ ID NO: 164 - protein, 5 aa, Artificial sequence
  synthetic amino acid sequence
SNVSV

SEQ ID NO: 165 - protein, 9 aa, Artificial sequence
  synthetic amino acid sequence
TYSTYGKFL

SEQ ID NO: 166 - protein, 9 aa, Artificial sequence
  synthetic amino acid sequence
LIFCHSKKK

SEQ ID NO: 167 - protein, 16 aa, Artificial sequence
  synthetic amino acid sequence
ATDALMTGFTGDFDSV

SEQ ID NO: 168 - protein, 10 aa, Artificial sequence
  synthetic amino acid sequence
VLAALAAYCL

SEQ ID NO: 169 - protein, 9 aa, Artificial sequence
  synthetic amino acid sequence
ILAGYGAGV

SEQ ID NO: 170 - protein, 8 aa, Artificial sequence
  synthetic amino acid sequence
IPFYGKAI

SEQ ID NO: 171 - protein, 9 aa, Artificial sequence
  synthetic amino acid sequence
RAQAPPPSW

SEQ ID NO: 172 - protein, 36 aa, Artificial sequence
  synthetic amino acid sequence
EGAVQWMNRLIAFASRGNHVSPTHYVPESDAAARVT

SEQ ID NO: 173 - protein, 9 aa, Artificial sequence
  synthetic amino acid sequence
RPDYNPPLL

SEQ ID NO: 174 - protein, 9 aa, Artificial sequence
  synthetic amino acid sequence
TIMAKNEVF

SEQ ID NO: 175 - protein, 29 aa, Artificial sequence
  synthetic amino acid sequence
AIPLEVIKGGRHLIFCHSKKKCDELAAKL

SEQ ID NO: 176 - protein, 50 aa, Artificial sequence; identical to SEQ ID NO: 11
  synthetic amino acid sequence

SEQ ID NO: 177 - protein, 52 aa, Artificial sequence; identical to SEQ ID NO: 2
  synthetic amino acid sequence

SEQ ID NO: 178 - protein, 70 aa, Artificial sequence; identical to SEQ ID NO: 3
  synthetic amino acid sequence

SEQ ID NO: 179 - protein, 100 aa, Artificial sequence; identical to SEQ ID NO: 4
  synthetic amino acid sequence

SEQ ID NO: 180 - protein, 171 aa, Artificial sequence; identical to SEQ ID NO: 63
  synthetic amino acid sequence

SEQ ID NO: 181 - protein, 228 aa, Artificial sequence; identical to SEQ ID NO: 10
  synthetic amino acid sequence

SEQ ID NO: 182 - protein, 553 aa, Artificial sequence
  synthetic amino acid sequence
QASLLKVPYFVRVQGLLRICALARKMAGGHYVQMAIIKLGALTGTYVYNHLTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDSRGSLLSPRPISYLKGSAGGPLLCPAGHAVGIFRAAVCTRGVAKAVDFIPVENLETTMRSPVFTDNSSPPAVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCN

SEQ ID NO: 183 - protein, 778 aa, Artificial sequence; identical to SEQ ID NO: 64
  synthetic amino acid sequence

SEQ ID NO: 184 - protein, 1985 aa, Artificial sequence; identical to SEQ ID NO: 13
  synthetic amino acid sequence

SEQ ID NO: 185 - protein, 3012 aa, Artificial sequence
  synthetic amino acid sequence
  misc_feature (3012)..(3012): Xaa can be any naturally occurring amino acid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTTALVVAQLLRIPQAILDMIAGAHWGVLAGIAYFSMVGNWAKVLVVLLLFAGVDAETHVTGGSAARTTSGLASLFTPGAKQNIQLINTNGSWHINRTALNCNDSLNTGWLAGLFYYHKFNSSGCPERLASCRPLTDFDQGWGPISYANGSGPDQRPYCWHYPPKPCGIVPAKSVCGPVYCFTPSPVVVGTTDRSGAPTYNWGENDTDVFVLNNTRPPLGNWFGCTWMNSTGFTKVCGAPPCVIGGVGNNTLHCPTDCFRKHPEATYSRCGSGPWITPRCLVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVVLNAASLAGTHGLVSFLVFFCFAWYLKGRWVPGAAYALYGMWPLLLLLLALPQRAYALDTEVAASCGGVVLVGLMALTLSPYYKRYISWCLWWLQYFLTRVEAQLHVWVPPLNVRGGRDAVILLMCVVHPTLVFDITKLLLAVFGPLWILQASLLKVPYFVRVQGLLRICALARKMAGGHYVQMAIIKLGALTGTYVYNHLTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDSRGSLLSPRPISYLKGSSGGPLLCPAGHAVGIFRAAVCTRGVAKAVDFIPVENLETTMRSPVFTDNSSPPAVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDFSLDPTFTIETTTLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPITKYIMTCMSADLEVVTSTWVLVGGVLAALAAYCLSTGCVVIVGRIVLSGKPAIIPDREVLYREFDEMEECSQHLPYIEQGMMLAEQFKQKALGLLQTASRQAEVIAPAVQTNWQKLEAFWAKHMWNFISGIQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGGNITRVESENKVVILDSFDPLVAEEDEREISVPAEILRKSRRFAPALPIWARPDYNPPLLETWKKPDYEPPVVHGCPLPPPQSPPVPPPRKKRTVVLTESTVSTALAELATKSFGSSSTSGITGDNTTTSSEPAPSGCPPDSDAESYSSMPPLEGEPGDPDLSDGSWSTVSSEADTEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVFPDLGVRVCEKMALYDVVSKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARSVRARLLSRGGRAAICGKYLFNWAVRTKLKLTPIAAAGQLDLSGWFTAGYSGGDIYHSVSHARPRWFWFCLLLLAAGVGIYLLPNRX

SEQ ID NO: 186 - protein, 3014 aa, Artificial sequence
  synthetic amino acid sequence
  misc_feature (197)..(197): Xaa can be any naturally occurring amino acid
  misc_feature (241)..(241): Xaa can be any naturally occurring amino acid
  misc_feature (251)..(251): Xaa can be any naturally occurring amino acid
  misc_feature (290)..(290): Xaa can be any naturally occurring amino acid
  misc_feature (331)..(331): Xaa can be any naturally occurring amino acid
  misc_feature (334)..(334): Xaa can be any naturally occurring amino acid
  misc_feature (343)..(344): Xaa can be any naturally occurring amino acid
  misc_feature (372)..(372): Xaa can be any naturally occurring amino acid
  misc_feature (390)..(390): Xaa can be any naturally occurring amino acid
  misc_feature (407)..(407): Xaa can be any naturally occurring amino acid
  misc_feature (433)..(433): Xaa can be any naturally occurring amino acid
  misc_feature (476)..(476): Xaa can be any naturally occurring amino acid
  misc_feature (523)..(523): Xaa can be any naturally occurring amino acid
  misc_feature (597)..(597): Xaa can be any naturally occurring amino acid
  misc_feature (715)..(715): Xaa can be any naturally occurring amino acid
  misc_feature (767)..(767): Xaa can be any naturally occurring amino acid
  misc_feature (786)..(786): Xaa can be any naturally occurring amino acid
  misc_feature (792)..(792): Xaa can be any naturally occurring amino acid
  misc_feature (821)..(821): Xaa can be any naturally occurring amino acid
  misc_feature (826)..(826): Xaa can be any naturally occurring amino acid
  misc_feature (843)..(843): Xaa can be any naturally occurring amino acid
  misc_feature (857)..(857): Xaa can be any naturally occurring amino acid
  misc_feature (873)..(874): Xaa can be any naturally occurring amino acid
  misc_feature (884)..(884): Xaa can be any naturally occurring amino acid
  misc_feature (922)..(922): Xaa can be any naturally occurring amino acid
  misc_feature (928)..(928): Xaa can be any naturally occurring amino acid
  misc_feature (955)..(955): Xaa can be any naturally occurring amino acid
  misc_feature (1020)..(1020): Xaa can be any naturally occurring amino acid
  misc_feature (1099)..(1099): Xaa can be any naturally occurring amino acid
  misc_feature (1143)..(1143): Xaa can be any naturally occurring amino acid
  misc_feature (1161)..(1161): Xaa can be any naturally occurring amino acid
  misc_feature (1210)..(1210): Xaa can be any naturally occurring amino acid
  misc_feature (1223)..(1223): Xaa can be any naturally occurring amino acid
  misc_feature (1371)..(1371): Xaa can be any naturally occurring amino acid
  misc_feature (1385)..(1385): Xaa can be any naturally occurring amino acid
  misc_feature (1409)..(1409): Xaa can be any naturally occurring amino acid
  misc_feature (1599)..(1599): Xaa can be any naturally occurring amino acid
  misc_feature (1607)..(1607): Xaa can be any naturally occurring amino acid
  misc_feature (1695)..(1695): Xaa can be any naturally occurring amino acid
  misc_feature (1753)..(1753): Xaa can be any naturally occurring amino acid
  misc_feature (1874)..(1874): Xaa can be any naturally occurring amino acid
  misc_feature (2071)..(2072): Xaa can be any naturally occurring amino acid
  misc_feature (2074)..(2074): Xaa can be any naturally occurring amino acid
  misc_feature (2087)..(2087): Xaa can be any naturally occurring amino acid
  misc_feature (2106)..(2106): Xaa can be any naturally occurring amino acid
  misc_feature (2134)..(2134): Xaa can be any naturally occurring amino acid
  misc_feature (2279)..(2279): Xaa can be any naturally occurring amino acid
  misc_feature (2321)..(2321): Xaa can be any naturally occurring amino acid
  misc_feature (2335)..(2335): Xaa can be any naturally occurring amino acid
  misc_feature (2358)..(2358): Xaa can be any naturally occurring amino acid
  misc_feature (2361)..(2362): Xaa can be any naturally occurring amino acid
  misc_feature (2364)..(2364): Xaa can be any naturally occurring amino acid
  misc_feature (2367)..(2367): Xaa can be any naturally occurring amino acid
  misc_feature (2373)..(2374): Xaa can be any naturally occurring amino acid
  misc_feature (2376)..(2376): Xaa can be any naturally occurring amino acid
  misc_feature (2383)..(2383): Xaa can be any naturally occurring amino acid
  misc_feature (2487)..(2487): Xaa can be any naturally occurring amino acid
  misc_feature (2496)..(2496): Xaa can be any naturally occurring amino acid
  misc_feature (2542)..(2542): Xaa can be any naturally occurring amino acid
  misc_feature (2546)..(2546): Xaa can be any naturally occurring amino acid
  misc_feature (2572)..(2572): Xaa can be any naturally occurring amino acid
  misc_feature (2601)..(2601): Xaa can be any naturally occurring amino acid
  misc_feature (2653)..(2653): Xaa can be any naturally occurring amino acid
  misc_feature (2660)..(2660): Xaa can be any naturally occurring amino acid
  misc_feature (2676)..(2676): Xaa can be any naturally occurring amino acid
  misc_feature (2689)..(2689): Xaa can be any naturally occurring amino acid
  misc_feature (2695)..(2695): Xaa can be any naturally occurring amino acid
  misc_feature (2722)..(2722): Xaa can be any naturally occurring amino acid
  misc_feature (2757)..(2757): Xaa can be any naturally occurring amino acid
  misc_feature (2798)..(2798): Xaa can be any naturally occurring amino acid
  misc_feature (2857)..(2857): Xaa can be any naturally occurring amino acid
  misc_feature (2863)..(2863): Xaa can be any naturally occurring amino acid
  misc_feature (2966)..(2966): Xaa can be any naturally occurring amino acid
  misc_feature (3002)..(3002): Xaa can be any naturally occurring amino acid
  misc_feature (3014)..(3014): Xaa can be any naturally occurring amino acid
MSTNPKPQRKTKRNTNRRPQDVKFPGGGQIVGGVYLLPRRGPRLGVRATRKTSERSQPRGRRQPIPKARRSEGRSWAQPGYPWPLYGNEGCGWAGWLLSPRGSRPSWGPTDPRRRSRNLGKVIDTLTCGFADLMGYIPLVGAPLGGVARALAHGVRVLEDGINYATGNLPGCSFSIFLLALLSCLTVPASAYEVRNXSGLYHVTNDCPNSSIVYEADDAILHTPGCVPCVREGNTSRCWVXVTPTVAVRYXGAPTTSLRRHVDLLVGAATLCSALYVGDLCGAVFLVGQXFTFSPRRHWTVQDCNCSIYPGHITGHRMAWDMMMNWSPTTXLVXAQLLRIPQXXLDIIAGAHWGVLAGLAYFSMQGNWAKVXVLLLFAGVDAETHTTGGXAARTTSGLTSLFSPGPXQNLQLINTNGSWHINRTALNCNDSLXTGFIAGLFYTHKFNSSGCPERLASCRPLTDFDQGWGPLTYANXISGPSDDRPYCWHYPPRPCGIVPARSVCGPVYCFTPSPVVVGTTDRXGVPTYTWGENETDVFLLNSTRPPQGNWFGCTWMNSTGFTKTCGAPPCNIGGGGNNDLLCPTDCFRKHPEATYSXCGSGPWLTPRCLVDYPYRLWHYPCTVNFTIFKVRMYVGGVEHRLEAACNWTRGERCDLEDRDRSELSPLLHSTTEWAILPCSFTTLPALSTGLIHLHQNIVDVQYLYGVGSAVVSWAXKWEYVVLLFLLLADARVCACLWMMLLISQAEAALENLVVLNAASAAGTHGIXWFLVFFCAAWYLKGRLVPXATYALXGLWPLLLLLLALPQRAYALDREVAASLGXAVLVXLTIFTLSPHYKHLLSRXLWWLQYFITRAEAXLQVWVPPLNVRGGRDXXILLTCLLHPXLVFDITKLLLAVLGPLYLLQASLLRVPYFVRAHALLRXCMLVRXLAGGKYVQMALLKLGRWTGTYIYDHLXPLSDWAAAGLRDLAVAVEPVIFSPMEKKVITWGADTAACGDILCGLPVSARLGREILLGPADDYXSKGWRLLAPITAYAQQTRGLLGTIVTSLTGRDKNEVEGEVQVLSTATQTFLGTCINGVMWTVYHGAGSKTLAGPKGPVXQMYTNVDQDLVGWPAPPGAKSLTPCTCGSSDLYLVTRHADVIPXRRRGDSRGSLLSPRPISXLKGSSGGPVLCPSGHAVGIFRAAVCTRGVAKAVDFIPVESLETTMRSPXFTDNSTPPAVPQXYQVGYLHAPTGSGKSTKVPAAYAAQGYKVLVLNPSVAATLGFGAYMSKAHGIDPNIRTGVRTVTTGAPITYSTYGKFLADGGCSGGAYDIIICDECHSTDATTILGIGTVLDQAETAGVRLVVLATATPPGSVTVPHPNIEEVALGTXGEIPFYGKAIPLEXIKGGRHLIFCHSKKKCDELAAKLXGLGLNAVAYYRGLDVSVIPTSGDVVVVATDALMTGFTGDFDSVIDCNVAVTQTVDFSLDPTFTIETTTVPQDAVSRSQRRGRTGRGRLGIYRYVSPGERPSGMFDSVVLCECYDAGCAWYELTPAETTVRLRAYLNTPGLPVCQDHLEFWEGVFTGLTHIDAHFLSQTKQSGENFPYLVAYQATVCARAXAPPPSWDXMWKCLIRLKPTLHGPTPLLYRLGAVQNEVTLTHPITKYIMTCMSADLEVVTSTWVLVGGVLAALAAYCLSTGCVVIVGRIVLSGKPAXIPDREVLYQQFDEMEECSQHLPYIEQGQQIAEQFKQKALGLLQTATKQAEVIAPAVQXNWQKLEQFWAKHMWNFISGIQYLAGLSTLPGNPAVASLMAFTAAVTSPLTTSQTLLFNILGGWVASQLAPPTAATAFVVSGLAGAAVGSIGLGKVLVDILAGYGAGVAGALVAFKIMSGEXPSTEDLVNLLPAILSPGALVVGVVCAAILRRHVGPGEGAVQWMNRLIAFASRGNHVSPTHYVPESDAAARVTQILSSLTVTSLLRRLHQWINEDCSTPCSGSWLRDIWDWVCTVLSDFKTWLKAKLLPQLPGIPFLSCQRGYKGVWRGDGVMHTRCPCGAEITGHVKNGSMRIVGPKTCSNTWHGTFPINAYTTGPXXPXPAPNYKRALWRVXAEEYVEVRRVGDFHYVTGXTTDNLKCPCQVPAPEFFTEVDGVRLHRXAPPCKPLLRDEVTFSVGLNSYVVGSQLPCEPEPDVAVLTSMLTDPSHITAETAARRLARGSPPSLASSSASQLSAPSLKATCTTHHDHPDAELIEANLLWRQEMGGNITRVESENKVVILDSFDPLVAEEDDREISVPAECLRKXRKFPPALPIWARPDYNPPLLETWKRPDYEPPTVHGCALPPPXAPPVPPPRRKRTVXLTESTVSTALAELAEKSFGSSEXSGXXSXSGXDTTSSXXSXPPDCDAXSDAESYSSMPPLEGEPGDPDLSDGSWSTVSDEEDSVVCCSMSYSWTGALITPCAAEEEKLPINPLSNSLLRHHNLVYSTTSRSASQRQKKVTFDRLQVLDDHYXDVLKEVKAXASKVKARLLSVEEACALTPPHSARSKFGYGAKDVRSLSRKAVNHIXSVWXDLLEDSTTPIPTTIMAKNEVFCVDPXKGGRKPARLIVYPDLGVRVCEKRALYDVXQKLPKAVMGSSYGFQYSPAQRVEFLLKAWKSKKTPMGFSYDTRCFDSTVTEXDIRTEEXIYQCCDLDPEARKAIXSLTERLYVGGPMXNSKGQXCGYRRCRASGVLTTSMGNTLTCYIKAXAACRAAGLRDCTMLVCGDDLVVICESAGVZEDAAXLRAFTEAMTRYSAPPGDPPQPEYDLELITSCSSNVSVAHDXSGKRVYYLTRDPTTPLARAAWETARHTPVNSWLGNIIMYAPTIWVRMVLMTHFFSILQXQEQLEXALDFEMYGATYSVTPLDLPAIIQRLHGLSAFSLHSYSPGELNRVAACLRKLGVPPLRAWRHRARAVRAKLIAQGGRAAICGKYLFNWAVRTKLKLTPLPAAGXLDLSSWFTVGAGGGDIYHSVSRARPRWLLLCLLLLXVGVGIFLLPARX

SEQ ID NO: 187 - protein, 3012 aa, Artificial sequence; identical to SEQ ID NO: 185
  synthetic amino acid sequence
  misc_feature (3012)..(3012): Xaa can be any naturally occurring amino acid

SEQ ID NO: 188 - protein, 3008 aa, Artificial sequence
  synthetic amino acid sequence
  misc_feature (3008)..(3008): Xaa can be any naturally occurring amino acid
MSTNPKPQRKTKRNTNRRPQDVKFPGGGQIVGGVYLLPRRGPRLGVRATRKTSERSQPRGRRQPIPKARRPEGRAWAQPGYPWPLYGNEGMGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGVYHVTNDCSNSSIVYEAADMIMHTPGCVPCVRENNSSRCWVALTPTLAARNASVPTTTIRRHVDLLVGAAAFCSAMYVGDLCGSVFLVSQLFTFSPRRHETVQDCNCSIYPGHVSGHRMAWDMMMNWSPTTALVVSQLLRIPQAVVDMVAGAHWGVLAGLAYYSMVGNWAKVLIVMLLFAGVDGTHVTGGAAARTTSGFTSLFSPGPSQKIQLINTNGSWHINRTALNCNDSLQTGFLAALFYTHKFNSSGCPERMASCRPIDKFAQGWGPITYAEPSSDQRPYCWHYAPRPCGIVPASQVCGPVYCFTPSPVVVGTTDRFGVPTYSWGENETDVLLLNNTRPPQGNWFGCTWMNSTGFTKTCGGPPCNIGGVGNNTLTCPTDCFRKHPEATYTKCGSGPWLTPRCLVDYPYRLWHYPCTVNFTIFKVRMYVGGVEHRLNAACNWTRGERCDLEDRDRSELSPLLLSTTEWQILPCSFTTLPALSTGLIHLHQNIVDVQYLYGIGSAVVSFAIKWEYVLLLFLLLADARVCACLWMMLLIAQAEAALENLVVLNAASVAGAHGILSFLVFFCAAWYIKGRLVPGAAYAFYGVWPLLLLLLALPPRAYAMDREMAASCGGAVFVGLALLTLSPHYKVFLARLIWWLQYFITRAEAHLQVWIPPLNVRGGRDAIILLTCAVHPELIFDITKLLLAILGPLMVLQAGITRVPYFVRAQGLIRACMLVRKVAGGHYVQMAFMKLAALTGTYVYDHLTPLRDWAHAGLRDLAVAVEPVVFSDMETKIITWGADTAACGDIILGLPVSARRGREILLGPADSLEGQGWRLLAPITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSSGGPLLCPSGHAVGIFRAAVCTRGVAKAVDFVPVESMETTMRSPVFTDNSSPPAVPQTFQVAHLHAPTGSGKSTKVPAAYAAQGYKVLVLNPSVAATLGFGAYMSKAHGVDPNIRTGVRTITTGAPITYSTYGKFLADGGCSGGAYDIIICDECHSTDSTTILGIGTVLDQAETAGARLVVLATATPPGSVTVPHPNIEEVALSNTGEIPFYGKAIPIETIKGGRHLIFCHSKKKCDELAAKLSGLGLNAVAYYRGLDVSVIPTSGDVVVVATDALMTGFTGDFDSVIDCNTCVTQTVDFSLDPTFTIETTTVPQDAVSRSQRRGRTGRGRRGIYRFVTPGERPSGMFDSSVLCECYDAGCAWYELTPAETSVRLRAYLNTPGLPVCQDHLEFWESVFTGLTHIDAHFLSQTKQAGDNFPYLVAYQATVCARAQAPPPSWDQMWKCLIRLKPTLHGPTPLLYRLGAVQNEVTLTHPITKYIMACMSADLEVVTSTWVLVGGVLAALAAYCLTTGSVVIVGRIILSGKPAIIPDREVLYQEFDEMEECASHLPYIEQGMQLAEQFKQKALGLLQTATKQAEAAAPVVESKWRALEFWAKHMWNFISGIQYLAGLSTLPGNPAIASLMAFTASITSPLTTQHTLLFNILGGWVAAQLAPPSAASAFVGAGIAGAAVGSIGLGKVLVDILAGYGAGVAGALVAFKVMSGEMPSTEDLVNLLPAILSPGALVVGVVCAAILRRHVGPGEGAVQWMNRLIAFASRGNHVSPTHYVPESDAAARVTQILSSLTITQLLKRLHQWINEDCSTPCSGSWLRDVWDWICTVLTDFKTWLQSKLLPRLPGVPFLSCQRGYKGVWRGDGIMQTTCPCGAQITGHVKNGSMRIVGPKTCSNTWHGTFPINAYTTGPCTPSPAPNYSRALWRVAAEEYVEVTRVGDFHYVTGMTTDNVKCPCQVPAPEFFTEVDGVRLHRYAPACKPLLREEVTFQVGLNQYLVGSQLPCEPEPDVAVLTSMLTDPSHITAETAKRRLARGSPPSLASSSASQLSAPSLKATCTTRHDSPDADLIEANLLWRQEMGGNITRVESENKVVILDSFDPLRAEEDEREVSVPAEILRKSRKFPPAMPIWARPDYNPPLLESWKDPDYVPPVVHGCPLPPTKAPPIPPPRRKRTVVLTESTVSSALAELATKTFGSSESSAVDSGTATAPPDQPSDDGDAGSDVESYSSMPPLEGEPGDPDLSDGSWSTVSEEASEDVVCCSMSYTWTGALITPCAAEESKLPINALSNSLLRHHNMVYATTSRSASQRQKKVTFDRLQVLDDHYRDVLKEMKAKASTVKAKLLSVEEACKLTPPHSARSKFGYGAKDVRNLSSKAVNHIRSVWKDLLEDTETPIDTTIMAKNEVFCVQPEKGGRKPARLIVFPDLGVRVCEKMALYDVVSTLPQAVMGSSYGFQYSPGQRVEFLVNAWKSKKCPMGFAYDTRCFDSTVTESDIRVEESIYQCCDLAPEARQAIRSLTERLYIGGPLTNSKGQNCGYRRCRASGVLTTSCGNTLTCYLKASAACRAAKLQDCTMLVCGDDLVVICESAGTQEDAASLRVFTEAMTRYSAPPGDPPQPEYDLELITSCSSNVSVAHDASGKRVYYLTRDPTTPLARAAWETARHTPVNSWLGNIIMYAPTLWARMILMTHFFSILLAQEQLEKALDCQIYGACYSIEPLDLPQIIQRLHGLSAFSLHSYSPGEINRVASCLRKLGVPPLRVWRHRARSVRAKLLSQGGRAATCGKYLFNWAVRTKLKLTPIPAASQLDLSGWFVAGYSGGDIYHSLSRARPRWFMWCLLLLSVGVGIYLLPNRX

SEQ ID NO: 189 - protein, 3034 aa, Artificial sequence
  synthetic amino acid sequence
  misc_feature (250)..(250): Xaa can be any naturally occurring amino acid
  misc_feature (406)..(406): Xaa can be any naturally occurring amino acid
  misc_feature (408)..(409): Xaa can be any naturally occurring amino acid
  misc_feature (3023)..(3023): Xaa can be any naturally occurring amino acid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPTDPRHRSRNVGKVIDTLTCGFADLMGYIPVVGAPLGGVARALAHGVRVLEDGVNYATGNLPGCSFSIFLLALLSCITVPVSAAQVKNTSSSYMVTNDCSNDSITWQLQAAVLHVPGCVPCEKVGNNTSRCWIPVSPNVAVXQPGALTQGLRTHIDMVVMSATLCSALYVGDLCGGVMLAAQMFIVSPQHHWFVQECNCSIYPGTITGHRMAWDMMMNWSPTATMILAYAMRVPEVIIDIISGAHWGVMFGLAYFSMQGAWAKVVVILLLAAGVDAGTHTVGGSAAHTTSGLAGLFSXGXXQNIQLINTNGSWHINRTALNCNDSLNTGFLASLFYTHRFNSSGCPERLSACRNIEAFRIGWGTLQYEDNVTNPEDMRPYCWHYPPKQCGIVPARSVCGPVYCFTPSPVVVGTTDRLGVPTYTWGENETDVFLLNSTRPPQGSWFGCTWMNSTGFTKTCGAPPCRIRADFNASTDLLCPTDCFRKHPEATYIKCGSGPWLTPRCLVDYPYRLWHYPCTVNYTIFKIRMYVGGVEHRLTAACNFTRGDRCNLEDRDRSQLSPLLHSTTEWAILPCSYSDLPALSTGLLHLHQNIVDVQYMYGLSPALTKYVVRWEWVVLLFLLLADARVCACLWMLILLGQAEAALEKLVVLHAASAASCNGFLYFVIFFVAAWYIKGRAVPLAAYSLTGLWPFCLLLLALPQQAYAYDASVHGQIGAALLILITLFTLTPGYKTLLSRCLWWLCYLLTLGEAMVQEWAPPMQARGGRDGIIWAATIFCPGVVFDITKWLLAVLGPAYLLRDALTRVPYFVRAHALLRMCTMVRHLAGGRYVQMALLALGRWTGTYIYDHLTPMSDWAASGLRDLAVAVEPIIFSPMEKKVIVWGAETAACGDILHGLPVSARLGREILLGPADGYTSKGWRLLAPITAYAQQTRGLLGAIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGIFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGEAITYSTYGKFLADGGCAGGAYDIIICDECHAVDATTILGIGTVLDQAETAGVRLTVLATATPPGSVTTPHPNIEEVALGQEGEIPFYGRAIPLSYIKGGRHLIFCHSKKKCDELAAALRGMGLNAVAYYRGLDVSIIPTQGDVVVVATDALMTGYTGDFDSVIDCNVAVTQVVDFSLDPTFTITTQTVPQDAVSRSQRRGRTGRGRLGIYRYVSTGERASGMFDSVVLCECYDAGAAWYELTPAETTVRLRAYFNTPGLPVCQDHLEFWEAVFTGLTHIDAHFLSQTKQSGENFAYLVAYQATVCARAKAPPPSWDVMWKCLTRLKPTLVGPTPLLYRLGSVTNEVTLTHPVTKYIATCMQADLEVMTSTWVLAGGVLAAVAAYCLATGCVSIIGRLHINQRAVVAPDKEVLYEAFDEMEECASRAALIEEGQRIAEMLKSKIQGLLQQASKQAQDIQPAVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCAGSWLRDVWDWVCTILTDFKNWLTSKLFPKMPGLPFISCQKGYKGVWAGTGIMTTRCPCGANISGNVRLGSMRITGPKTCMNTWQGTFPINCYTEGQCVPKPAPNFKTAIWRVAASEYAEVTQHGSYSYITGLTTDNLKVPCQLPSPEFFSWVDGVQIHRFAPTPKPFFRDEVSFCVGLNSFVVGSQLPCDPEPDTDVLMSMLTDPSHITAEAAARRLARGSPPSEASSSASQLSAPSLRATCTTHGKTYDVDMVDANLFMGGDVTRIESESKVVVLDSLDPMAEERSDLEPSIPSEYMLPRNRFPPALPAWARPDYNPPLVESWKRPDYQPPTVAGCALPPPKKTPTPPPRRRRTVGLSESTIGDALQQLAIKTFGQPPPSGDSGLSTGADAADSGGRTPPDELALSETGSISSMPPLEGEPGDPDLEPEQVELQPPPQGGEVAPGSDSGSWSTCSEEDDSVVCCSMSYSWTGALITPCSPEEEKLPINPLSNSLLRYHNKVYCTTSKSASLRAKKVTFDRMQVLDAHYDSVLKDIKLAASKVSARLLTLEEACQLTPPHSARSKYGFGAKEVRSLSGRAVNHIKSVWKDLLEDSQTPIPTTIMAKNEVFCVDPTKGGKKAARLIVYPDLGVRVCEKMALYDVTQKLPQAVMGASYGFQYSPAQRVEFLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWVRMVLMTHFFSILMAQDTLDQNLNFEMYGSVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGDIYHSVSRARPRLLLLSLLLLXVGVGLFLLPAR

SEQ ID NO: 190 - protein, 3033 aa, Artificial sequence
  synthetic amino acid sequence
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGKVIDTITCGFADLMGYIPVVGAPVGGVARALAHGVRVLEDGINYATGNLPGCSFSIFLLALLSCVTVPVSAVEVRNISSSYYATNDCSNNSITWQLTNAVLHLPGCVPCENDNGTLRCWIQVTPNVAVKHRGALTHNLRTHVDMIVMAATVCSALYVGDVCGAVMIVSQALIVSPERHNFTQECNCSIYQGHITGHRMAWDMMLNWSPTLTMILAYAARVPELVLEVVFGGHWGVVFGLAYFSMQGAWAKVIAILLLVAGVDATTYSSGAQAGRTTSGFAGLFSPGPKQNIQLINTNGSWHINRTALNCNDSLQTGFIASLFYTNNFNSSGCPERLSSCRGLDDFRIGWGTLEYETNVTNDEDMRPYCWHYPPKPCGIVSARTVCGPVYCFTPSPVVVGTTDRQGVPTYSWGENETDVFLLNSTRPPQGAWFGCTWMNGTGFTKTCGAPPCRIRRDYNSTLDLLCPTDCFRKHPDATYLKCGAGPWLTPRCLVDYPYRLWHYPCTVNFTIFKVRMYVGGVEHRLSAACNFTRGDRCRLEDRDRGQQSPLLHSTTEWAVLPCSFSDLPALSTGLLHLHQNIVDVQYLYGLSPAITRYIVKWEWVVLLFLLLADARVCACLWMLIILGQAEAALEKLIILHSASAASANGPLWFFIFFTAAWYLKGRVVPVATYSVLGLWSFLLLVLALPQQAYALDAAEQGELGLVILVIISIFTLTPAYKILLSRSVWWLSYMLVLAEAQIQQWVPPLEARGGRDGIIWVAVILHPRLVFEVTKWLLAILGPAYLLKASLLRVPYFVRAHALLRVCTLVRHLAGARYIQMLLITIGRWTGTYIYDHLSPLSTWAAQGLRDLAVAVEPVVFSPMEKKVIVWGAETVACGDILHGLPVSARLGREVLLGPADSYTSKGWKLLAPITAYTQQTRGLLGAIVVSLTGRDKNEQAGQVQVLSSVTQSFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCPRGHAVGLFRAAVCARGVAKSIDFIPVESLDIATRTPSFSDNSTPPAVPQSYQVGYLHAPTGSGKSTKVPAAYASQGYKVLVLNPSVAATLGFGAYMSKAHGINPNIRTGVRTVTTGDPITYSTYGKFLADGGCSAGAYDVIICDECHSVDATTILGIGTVLDQAETAGARLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVTQIVDFSLDPTFTITTQTVPQDAVSRSQRRGRTGRGRLGIYRYVSSGERPSGMFDSVVLCECYDAGAAWYELTPAETTVRLRAYFNTPGLPVCQDHLEFWEAVFTGLTHIDAHFLSQTKQGGDNFAYLTAYQATVCARAKAPPPSWDVMWKCLTRLKPTLTGPTPLLYRLGAVTNEVTLTHPVTKYIATCMQADLEIMTSTWVLAGGVLAAVAAYCLATGCISIIGRLHLNDQVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPSVEDVVNLLPAILSPGALVVGVICAAILRRHVGQGEGAVQWMNRLIAFASRGNHVAPTHYVAESDASQRVTQVLSSLTITSLLRRLHAWITEDCPVPCSGSWLRDIWDWVCSILTDFKNWLSSKLLPKMPGLPFISCQKGYRGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPTPGPFFRDEVTFTVGLNSFVVGSQLPCDPEPDTEVLASMLTDPSHITAEAAARRLARGSPPSQASSSASQLSAPSLKATCTTHKMAYDCDMVDANLFMGGDVTRIESDSKVIVLDSLDSMTEVEDDREPSVPSEYLIRRRKFPPALPPWARPDYNPPVIETWKRPGYEPPTVLGCALPPTPQAPVPPPRRRRAKVLTQDNVEGVLREMADKVLSPLQDHNDSGHSTGADTGGDSVQQPSDETAASEAGSLSSMPPLEGEPGDPDLEFEPAGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLSVEEACALTPPHSAKSRYGFGAKEVRSLSRRAVNHIRSVWEDLLEDQHTPIDTTIMAKNEVFCVDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPIMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLDAFSLHTYSPHELSRVAATLRKLGAPPLRAWKSRARAVRASLIAQGGRAAICGRYLFNWAVKTKLKLTPLPEASRLDLSGWFTVGAGGGDIFHSVSHARPRLLLLCLLLLSVGVGIFLLPAR

SEQ ID NO: 191 - protein, 3068 aa, Artificial sequence
  synthetic amino acid sequence
  misc_feature (385)..(385): Xaa can be any naturally occurring amino acid
  misc_feature (409)..(409): Xaa can be any naturally occurring amino acid
  misc_feature (585)..(585): Xaa can be any naturally occurring amino acid
  misc_feature (3048)..(3048): Xaa can be any naturally occurring amino acid
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCIPCVQTDGNTSTCWTPVTPTVAVKYVGATTASIRSHVDLLVGAATMCSALYVGDMCGAVFLVGQAFTFRPRRHQTVQTCNCSLYPGHLSGHRMAWDMMMNWSPAVGMVVAHVLRLPQTLFDIIAGAHWGILAGLAYYSMQGNWAKVAIIMVMFSGVDAXTHTTGGSAARGARGLTSLFSVGPXQNLQLVNTNGSWHINRTALNCNDSINTGFIAGLFYYHKFNSTGCPQRLSSCKPITFFRQGWGPLTDANNITGPSDDKPYCWHYAPRPCDVVPASSVCGPVYCFTPHHSPVVVGTTDAKGVPTYTWGENETDVFLLESLRPPSGRWFGCTWMNSTRGFVKTCGAPPCNIYGGGGNPXNNESDLFCPTDCFRKHPEATYSRCGAGPWLTPRCMVDYPYRLWHYPCTVNFTLFKVRMFVGGFEHRFTAACNWTRGERCDIEDRDRSEQHPLLHSTTELAILPCSFTPMPALSTGLIHLHQNIVDVQYLYGVGSGMVGWALKWEFVILVFLLLADARVCVALWLMLMISQAEAALENLVTLNAVAAAGTHGIGWYLVAFCAAWHVRRAGKLVPLVTYSLTGLWSLALLVLLLPQRAYAWSGEDSATLGAGILVLFGFFTLSPWYKHWIGRLMWWNQYTICRCEAALQVWVPPLLARGSRDGVILLTSLLYPSLIFDITKLLIAVLGPLYLIQAAITTTPYFVRAHVLVRLCMLVRSVMGGKYFQMIILSIGRWFNTYLYDHLAPMQHWAAAGLKDLAVATEPVIFSPMEIKVITWGADTAACGDILCGLPVSARLGREVLLGPADDYREMGWRLLAPITAYAQQTRGLLGTIVTSLTGRDKNVVTGEVQVLSTATQTFLGTTVGGVMWTVYHGAGSRTLAGAKHPALQMYTNVDQDLVGWPAPPGAKSLEPCACGSADLYLVTRDADVIPARRRGDSTASLLSPRPLACLKGSSGGPVMCPSGHVAGIFRAAVCTRGVAKALQFIPVETLSTQARSPSFSDNSTPPAVPQSYQVGYLHAPTGSGKSTKVPAAYVAQGYNVLVLNPSVAATLGFGSFMSRAYGIDPNIRTGNRTVTTGAKLTYSTYGKFLADGGCSGGAYDVIICDECHAQDATSILGIGTVLDQAETAGVRLTVLATATPPGSITVPHSNIEEVALGSEGEIPFYGKAIPIAQLKGGRHLIFCHSKKKCDEIASKLRGMGLNAVAYYRGLDVSVIPTTGDVVVCATDALMTGFTGDFDSVIDCNVAVEQYVDFSLDPTFSIETRTAPQDAVSRSQRRGRTGRGRLGTYRYVTPGERPSGMFDSVVLCECYDAGCSWYDLQPAETTVRLRAYLSTPGLPVCQDHLDFWESVFTGLTHIDAHFLSQTKQQGLNFSYLTAYQATVCARAQAPPPSWDETWKCLVRLKPTLHGPTPLLYRLGPVQNEICLTHPITKYIMACMSADLEVTTSTWSTWVLLGGVLAALAAYCLSVGCVVIVGHIELGGKPALVPDKEVLYQQYDEMEECSQAAPYIEQAQVIAHQFKEKVLGLLQRATQQQAVIEPIVATNWQKLEAFWHKHMWNFVSGIQYLAGLSTLPGNPAVASLMAFTASVTSPLTTNQTMFFNILGGWVATHLAGPQSSSAFVVSGLAGAAIGGIGLGRVLLDILAGYGAGVSGALVAFKIMGGELPTAEDMVNLLPAILSPGALVVGVICAAILRRHVGPGEGAVQWMNRLIAFASRGNHVSPTHYVPESDAAARVTALLSSLTVTSLLRRLHQWINEDYPSPCSGDWLRTIWDWVCTVLSDFKTWLSAKIMPALPGLPFISCQKGYKGVWRGDGVMSTRCPCGASITGHVKNGSMRLAGPRTCANMWHGTFPINEYTTGPSTPCPSPNYTRALWRVAANSYVEVRRVGDFHYITGATEDELKCPCQVPAAEFFTEVDGVRLHRYAPPCKPLLRDEITFMVGLNSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAETDDAELSVAAECFKKPPKYPPALPIWARPDYNPPLLDRWKAPDYVPPTVHGCALPPRGAPPVPPPRRKRTIQLDGSNVSAALAALAEKSFPSSKPQEENSSSSGVDTQSSTTSKVPPSPGGESDSESCSSMPPLEGEPGDPDLSCDQVELQPPPQGGGVAPGSGSGSWSTVSDSEEQSVVCCSMSYSWTGALITPCSAEEEKLPISPLSNSLLRHHNLVYSTSSRSASQRQKKVTFDRLQVLDDHYKTALKEVKERASRVKARMLTIEEACALVPPHSARSKFGYSAKDVRSLSSKAINQIRSVWEDLLEDTTTPIPTTIMAKNEVFCVDPAKGGRKPARLIVYPDLGVRVCEKRALYDVIQKLSIETMGSAYGFQYSPQQRVERLLKMWTSKKTPLGVLFSYDTRCFDSTVTGEQDIRVEEEIYQCCNLEPEARKVISSLTERLYCGGPMFNSKGAQCGYRRCRASGVLPTSFGNTITCYIKATAAARAAGLRNPDFLVCGDDLVVVAESDGVDEDRAALRAFTEAMTRLWTRYYSAPPGDAPHRPTLQPTYDLELITSCSSNVSVARDNKGKRYYYLTRDATTPLARAAWETARHTPGWGVNSWLGNIIMYAPTIWVRMVMMTHFFSILQSQEILDRPLDFEMYGATYSVTPLDLPAIIERLHGLSAFTLHSYSPVELNRVAGTLRKLGCPPLRAWRHRARAVRAKLIAQGGKAKICGLYLFNWAVRTKTKLTPLPAAGQLDLSSWFTVGVGGNDIYHSVSRARTRXLLLCLLLLTVGVGIFLLPAR

SEQ ID NO: 192 - protein, 3035 aa, Artificial sequence
  synthetic amino acid sequence
  misc_feature (232)..(232): Xaa can be any naturally occurring amino acid
  misc_feature (397)..(397): Xaa can be any naturally occurring amino acid
  misc_feature (407)..(407): Xaa can be any naturally occurring amino acid
  misc_feature (678)..(678): Xaa can be any naturally occurring amino acid
  misc_feature (1002)..(1002): Xaa can be any naturally occurring amino acid
MSTNPKPQRKTKRNTNRRPMDVKFPGGGQIVGGVYLLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRAVEDGINYATGNLPGCSFSIFLLALLSCLTVPASAINYRNTSGIYHVTNDCPNSSIVYEADHHILHLPGCVPCVRXGNQSRCWVALTPTVAAPYIGAPLESLRSHVDLMVGAATVCSALYIGDLCGGLFLVGQMFSFRPRRHWTTQDCNCSIYTGHITGHRMAWDMMMNWSPTTTLVLAQVMRIPSTLVDLLAGGHWGVLVGVAYFSMQANWAKVILVLFLFAGVDAETHVSGGAAGRTTXGLTSLFSPGXQQNLQLINSNGSWHINRTALNCNDSLNTGFLASLFYTHKFNSSGCPERLASCKSLDSFDQGWGPLGVANNISGPSDDRPYCWHYPPRPCGIVPASSVCGPVYCFTPSPVVVGTTDRLGVPTYTWGENESDVFLLNSTRPPQGAWFGCVWMNSTGFTKACGAPPCEVRTNNGTSTDWPCPTDCFRKHPETTYAKCGSGPWITPRCLIHYPYRLWHYPCTVNFTVFKIRTFIGGIEHRMEAACNWTRGEVCGLEHRDRAELSPLLLSTTTWQXLPCSFTTLPALSTGLIHLHQNIVDVQYLYGVGSAVVSWALKWEYVVLAFLLLADARVSACLWMMFMVSQVEAALSNLININAASAAGTHGFWYAIFFICIAWHVKGRLPAAATYAACGMWPLLLLLLMLPERAYAYDREVAGSLGGAVVVALTILTLSPHYKSWLARGLWWIQYFIARAEALLHVYVPSFDVRGPRDSLIILAVLACPHLVFDITKYLLAILGPLYILQASLLRVPYFVRAHALVKICSLLRGVVYGKYCQMAVLKVGALTGTYIYDHLTPLSDWAAEGLRDLAVALEPVVFTPMEKKVIVWGADTAACGDIIXGLPVSARLGNEILLGPADSETSKGWRLLAPITAYAQQTRGLFSTIITSLTGRDTNENCGEVQVLSTATQSFLGTAVNGVMWTVYHGAGSKTISGPKGPVNQMYTNVDQDLVGWPAPPGVKSLAPCTCGASDLYLVTRHADVVPVRRRGDTRGALLSPRPISTLKGSSGGPLLCPMGHAAGIFRAAVCTRGVAKAVDFVPVESLETTMRSPVFTDNSTPPAVPQTYQVAHLHAPTGSGKSTKVPAAYAAQGYKVLVLNPSVAATLGFGAYMSKAYGIDPNIRSGVRTITTGAPITYSTYGKFLADGGCSGGAYDIIICDECHSTDSTTILGIGTVLDQAETAGVRLVVLATATPPGSVTTPHSNIEEVALPTTGEIPFYGKAIPLELIKGGRHLIFCHSKKKCDELAKQLTSLGLNAVAYYRGLDVSVIPTSGDVVVCATDALMTGFTGDFDSVIDCNTSVIQTVDFSLDPTFSIETTTVPQDAVSRSQRRGRTGRGRLGIYRYVTPGERPSGIFDTSVLCECYDAGCAWYELTPAETTTRLRAYFNTPGLPVCQDHLEFWESVFTGLTQIDGHFLSQTKQSGENFPYLVAYQATVCARALAPPPSWDTMWKCLIRLKPTLHGPTPLLYRLGSVQNEVTLTHPITKYIMACMSADLEVVTSTWVLVGGVLAALAAYCLSVGSVVIVGRVVLSGQPAVIPDREVLYQQFDEMEECSKHLPLVEHGLQLAEQFKQKAVGLLNFAGKQAQEATPVIQSNFAKLEQFWAKHMWNFISGIQYLAGLSTLPGNPAIASLMSFTAAVTSPLTTQQTLLFNILGGWVASQIATPTASTAFVVSGLAGAAVGSVGLGKILVDILAGYGAGVAGAVVTFKIMSGEMPSTEDLVNLLPAILSPGALVVGVVCAAILRRHVGPGEGAVQWMNRLIAFASRGNHVSPTHYVPESDAAARVTQILSSLTVTSLLRRLHKWINEDCSTPCAESWLWEVWDWVCTVLSDFKTWLKAKLLPLMPGIPFLSCQRGYKGEWRGDGVMHTTCPCGAELAGHIKNGSMRITGPKTCSNTWHGTFPINAYTTGPGVPIPAPNYKFALWRVSAEEYVEVRRVGDFHYVTGVTQDNIKCPCQVPAPEFFTEVDGIRLHRHAPKCKPLLRDEVSFSVGLNSFVVGSQLPCEPEPDVAVLTSMLTDPSHITAETASRRLARGSPPSLASSSASQLSAPSLKATCTARHDSPGTDLLEANLLWGSTATRVETDEKVIILDSFEPCVAEPDDDREVSVAAEILRPTKKFPPALPIWARPDYNPPLTETWKQQDYKPPTVHGCALPPSKQPPVPPPRRKRTVQLTESVVSTALAELAAKTFGQSELGSDSGADLTTGPTETTDSGPILVDDASDDGSYSSMPPLEGEPGDPDLTSDQVELQPPPQGGGVAPGSGSGSWSTVSGSEDTVVCCSMSYSWTGALVTPCAAEESKLPISPLSNSLLRHHNMVYATTTRSAVTRQKKVTFDRLQVVDNHYNETLKEIKARASRVKARLLTTEEACDLTPPHSAKSKFGYGAKDVRSHSRKAINHINSVWEDLLEDNNTPIPTTIMAKNEVFAVNPAKGGRKPARLIVYPDLGGVRVCEKRALHDVINQLPKAVMGAAYGFQYSPAQRVEFLLTSWKSKKTPMGFSYDTRCFDSTVTEKDIRTEEEVYQCCDLEPEARKVITALTERLYVGGPMHNSKGDLCGYRRCRASGVYTTSFGNTLTCYLKATAAIKAAGLRDCTMLVCGDDLVVIAESDGVEEDNRALRAFTEAMTRYSAPPGDAPQPAYDLELITSCSSNVSVAHDATGKKVYYLTRDPETPLARAAWETVRHTPVNSWLGNIIVYAPTIWVRMVLMTHFFSILQSQEALEKALDFDMYGVTYSITPLDLPAIIQRLHGLSAFTLHGYSPHELNRVAGSLRKLGVPPLRAWRHRARAVRAKLIAQGGKAKICGIYLFNWAVKTKLKLTPLPAAANLDLSSWFTVGAGGGDIYHSVSRARPRYLLLCLLLLSVGVGIFLLPAR

SEQ ID NO: 193 - protein, 3013 aa, Artificial sequence
  synthetic amino acid sequence
  misc_feature (178)..(178): Xaa can be any naturally occurring amino acid
  misc_feature (189)..(189): Xaa can be any naturally occurring amino acid
  misc_feature (232)..(232): Xaa can be any naturally occurring amino acid
  misc_feature (251)..(251): Xaa can be any naturally occurring amino acid
  misc_feature (257)..(257): Xaa can be any naturally occurring amino acid
  misc_feature (285)..(285): Xaa can be any naturally occurring amino acid
  misc_feature (297)..(297): Xaa can be any naturally occurring amino acid
  misc_feature (300)..(300): Xaa can be any naturally occurring amino acid
  misc_feature (333)..(333): Xaa can be any naturally occurring amino acid
  misc_feature (365)..(365): Xaa can be any naturally occurring amino acid
  misc_feature (384)..(384): Xaa can be any naturally occurring amino acid
  misc_feature (386)..(386): Xaa can be any naturally occurring amino acid
  misc_feature (391)..(391): Xaa can be any naturally occurring amino acid
  misc_feature (396)..(398): Xaa can be any naturally occurring amino acid
  misc_feature (404)..(404): Xaa can be any naturally occurring amino acid
  misc_feature (442)..(442): Xaa can be any naturally occurring amino acid
  misc_feature (444)..(444): Xaa can be any naturally occurring amino acid
  misc_feature (476)..(476): Xaa can be any naturally occurring amino acid
  misc_feature (502)..(502): Xaa can be any naturally occurring amino acid
  misc_feature (523)..(523): Xaa can be any naturally occurring amino acid
  misc_feature (525)..(525): Xaa can be any naturally occurring amino acid
  misc_feature (529)..(529): Xaa can be any naturally occurring amino acid
  misc_feature (532)..(532): Xaa can be any naturally occurring amino acid
  misc_feature (547)..(547): Xaa can be any naturally occurring amino acid
  misc_feature (723)..(723): Xaa can be any naturally occurring amino acid
  misc_feature (742)..(742): Xaa can be any naturally occurring amino acid
  misc_feature (763)..(763): Xaa can be any naturally occurring amino acid
  misc_feature (773)..(773): Xaa can be any naturally occurring amino acid
  misc_feature (775)..(775): Xaa can be any naturally occurring amino acid
  misc_feature (779)..(779): Xaa can be any naturally occurring amino acid
  misc_feature (794)..(794): Xaa can be any naturally occurring amino acid
  misc_feature (825)..(825): Xaa can be any naturally occurring amino acid
  misc_feature (839)..(839): Xaa can be any naturally occurring amino acid
  misc_feature (844)..(844): Xaa can be any naturally occurring amino acid
  misc_feature (857)..(857): Xaa can be any naturally occurring amino acid
  misc_feature (905)..(905): Xaa can be any naturally occurring amino acid
  misc_feature (908)..(908): Xaa can be any naturally occurring amino acid
  misc_feature (914)..(914): Xaa can be any naturally occurring amino acid
  misc_feature (931)..(931): Xaa can be any naturally occurring amino acid
  misc_feature (1020)..(1021): Xaa can be any naturally occurring amino acid
  misc_feature (1088)..(1088): Xaa can be any naturally occurring amino acid
  misc_feature (1114)..(1114): Xaa can be any naturally occurring amino acid
  misc_feature (1118)..(1118): Xaa can be any naturally occurring amino acid
  misc_feature (1384)..(1384): Xaa can be any naturally occurring amino acid
  misc_feature (1613)..(1613): Xaa can be any naturally occurring amino acid
  misc_feature (1756)..(1756): Xaa can be any naturally occurring amino acid
  misc_feature (2262)..(2262): Xaa can be any naturally occurring amino acid
  misc_feature (2356)..(2356): Xaa can be any naturally occurring amino acid
  misc_feature (2374)..(2374): Xaa can be any naturally occurring amino acid
  misc_feature (2385)..(2385): Xaa can be any naturally occurring amino acid
  misc_feature (2540)..(2540): Xaa can be any naturally occurring amino acid
  misc_feature (2601)..(2601): Xaa can be any naturally occurring amino acid
  misc_feature (2636)..(2636): Xaa can be any naturally occurring amino acid
  misc_feature (2674)..(2674): Xaa can be any naturally occurring amino acid
  misc_feature (2994)..(2994): Xaa can be any naturally occurring amino acid
  misc_feature (3002)..(3002): Xaa can be any naturally occurring amino acid
MSTNPKPQRKTKRNTNRRPQDVKFPGGGQIVGGVYLLPRRGPRLGVRATRKTSERSQPRGRRQPIPKARRPTGRSWGQPGYPWPLYANEGLGWAGWLLSPRGSRPNWGPNDPRRKSRNLGKVIDTLTCGFADLMGYIPLVGGPVGGVARALAHGVRVLEDGINYATGNLPGCSFSIFXLALLSCLTVPXSAVPYRNASGVYHVTNDCPNSSIVYEAENLILHAPGCVPCVRXGNVSRCWVQITPTLSAPSXGAVTAXLRRAVDYLAGGAALCSALYVGDACGAVXLVGQMFTYSPRXHTXVQDCNCSIYSGHITGHRMAWDMMMNWSPTTALXMAQLLRIPQVVIDIIAGAHWGVLFAAAYFASXANWAKVILVLFLFAGVDAXTXTVGGXAGQGXXXLTSFFXPGPQQNLQLINTNGSWHINRTALNCNDSLQTGFIAGLXYXHKFNSSGCPQRMASCRPLAAFDQGWGTISYAXVSGPSDDKPYCWHYPPRPCGVVPARXVCGPVYCFTPSPVVVGTTDRXGXPTYXWGXNETDIFLLNNTRPPXGNWFGCTWMNSTGFVKTCGAPPCNLGPTGNNSLKCPTDCFRKHPDATYTKCGSGPWLTPRCLVHYPYRLWHYPCTVNYTIFKVRMFIGGLEHRLEAACNWTRGERCDLEDRDRAELSPLLHTTTQWAILPCSFTPTPALSTGLIHLHQNIVDTQYLYGLSSSIVSWAVKWEYIVLXFLLLADARICTCLWILLLXCQAEAALENVIVLNAAAAAGXHGFFWGLLVXCXAWHXKGRLVPGATYLCLGXWPLLLLLLLLPQRALALDSSDGGTVGCLVLXILTIFTLTPGYKKXVVLVXWWLQYFIARVEAXIHVWVPPLQVRGGRDAIIMLTCLFHPALGFEVTKILLGILGPLYLLQXSLXKVPYFXRARALLRACLLAKHLVXGKYVQAALLHLGRLTGTYIYDHLAPMKDWAASGLRDLAVATEPIIFSPMETKVITWGADTAACGDILAGLPVSARRGREIFLGPADDIXXAGWRLLAPITAYAQQTRGVLGAIVVSLTGRDKNEAEGEVQVLSTATQTFLGTCINGVMWTVFHGAGXKTLAGPKGPVVQMYTNVDKDLVGWPXPPGXRSLTPCTCGSADLYLVTRHADVIPARRRGDTRASLLSPRPISYLKGSSGGPIMCPSGHVVGVFRAAVCTRGVAKALDFIPVENLETTMRSPVFTDNSTPPAVPHEFQVGHLHAPTGSGKSTKVPAAYAAQGYKVLVLNPSVAATLGFGAYMSRAYGVDPNIRTGVRTVTTGAAITYSTYGKFLADGGCSGGAYDVIICDECHSQDATTILGIGTVLDQAETAGARLVVLATATPPGSVTTPHPNIEEVALPSEGEIPFYGRAIPLXLIKGGRHLIFCHSKKKCDELAKQLTSLGVNAVAYYRGLDVAVIPATGDVVVCSTDALMTGFTGDFDSVIDCNTAVTQTVDFSLDPTFTIETTTVPQDAVSRSQRRGRTGRGRHGIYRYVSSGERPSGIFDSVVLCECYDAGCAWYDLTPAETTVRLRAYLNTPGLPVCQDHLEFWEGVFTGLTNIDAHMLSQTKQGGENFPYLVAYQATVCVRAKAPPPSWDTMWKCMXRLKPTLTGPTPLLYRLGAVQNEITLTHPITKYIMACMSADLEVITSTWVLVGGVVAALAAYCLTVGSVAIVGRIILSGRPAIIPDREVLYQQFDEMEECSASLPYMDEARAIAEQFKEKVLGLIGTAGQKAETLKPAATSMWXKAEQFWAKHMWNFVSGIQYLAGLSTLPGNPAVATLMSFTAAVTSPLTTQQTLLFNILGGWVASQIAPPTAATAFVVSGMAGAAVGSIGLGRVLIDILAGYGAGVAGALVAFKIMCGERPTAEDLVNLLPSILCPGALVVGVICAAVLRRHIGPGEGAVQWMNRLIAFASRGNHVSPTHYVPETDASAKVTQLLSSLTVTSLLKRLHTWIGEDYSTPCDGTWLRAIWDWVCTALTDFKAWLQAKLLPQLPGVPFLSCQRGYKGVWRGDGVNSTKCPCGATISGHVKNGTMRIVGPKLCSNTWHGTFPINATTTGPSVPAPAPNYKFALWRVGAADYAEVRRVGDYHYITGVTQDNLKCPCQVPSPEFFTELDGVRIHRYAPPCNPLLREEVCFSVGLHSYVVGSQLPCEPEPDVTVLTSMLSDPAHITAETAKRRLDRGSPPSLASSSASQLSAPSLKATCTTQGHHPDADLIEANLLWRQCMGGNITRVEAENKVVILDSFEPLKXEEDDREISVSADCFRRGPAFPPALPIWARPGYDPPLLETWKRPDYDPPQVSGCPLPPAGLPPVPPPRRKRKPVELSDSTVSQVLADLADARFKXDTPSIEGQDSAVGTSSQXDSGPEEKRDDXSDAASYSSMPPLEGEPGDPDLSSGSWSTVSDEDSVVCCSMSYSWTGALITPCSAEEEKLPINPLSNTLLRHHNLVYSTSSRSAGLRQKKVTFDRLQVLDDHYREVVDEMKRLASKVKARLLPLEEACGLTPPHSARSKYGYGAKEVRSLDKKALXHIEGVWQDLLDDSDTPLPTTIMAKNEVFAVEPSKGGKKPARLIVYPDLGVRVCEKRALYDXAQKLPTALMGPSYGFQYSPAQRVEFLLKTWKSKKXPMAFSYDTRCFDSTVTEHDIMTEESIYQSCDLQPEARXAIRSLTQRLYCGGPMYNSKGQQCGYRRCRASGVFTTSMGNTMTCYIKALASCRAAKLRDCTLLVCGDDLVAICESQGTHEDEASLRAFTEAMTRYSAPPGDPPVPAYDLELVTSCSSNVSVARDASGNRVYYLTRDPQVPLARAAWETAKHSPVNSWLGNIIMYAPTLWARIVLMTHFFSVLQSQEQLEKALAFEMYGSVYSVTPLDLPAIIQRLHGLSAFSLHSYSPSEINRVASCLRKLGVPPLRAWRHRARAVRAKLIAQGGKAAICGIYLFNWAVKTKRKLTPLADADRLDLSSWFTVGAGGGDIYHSMSRARPRXLLCLLLLXVGVGIFLLPAR

SEQ ID NO: 194 - protein, 3014 aa, Artificial sequence
  synthetic amino acid sequence
  misc_feature (195)..(195): Xaa can be any naturally occurring amino acid
  misc_feature (237)..(237): Xaa can be any naturally occurring amino acid
  misc_feature (389)..(389): Xaa can be any naturally occurring amino acid
  misc_feature (400)..(400): Xaa can be any naturally occurring amino acid
  misc_feature (403)..(403): Xaa can be any naturally occurring amino acid
  misc_feature (572)..(572): Xaa can be any naturally occurring amino acid
  misc_feature (1877)..(1877): Xaa can be any naturally occurring amino acid
  misc_feature (1944)..(1944): Xaa can be any naturally occurring amino acid
  misc_feature (1967)..(1967): Xaa can be any naturally occurring amino acid
MSTLPKPQRKTKRNTNRRPMDVKFPGGGQIVGGVYLLPRRGPRLGVRATRKTSERSQPRGRRQPIPKARQPTGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASAVHYXNSSGIYHLTNDCPNSSIVYEADAMILHLPGCVPCVRVGNQSXCWVPVSPTLAVPNASTPATGFRRHVDLLVGAAAFCSALYIGDLCGGVFLVGQLFTFRPRRHQTVQDCNCSIYTGHVTGHRMAWDMMMNWSPTATLVLSSILRVPQLLLDIFLGGHWGVLGAVLYYSMVANWAKVLAVLLLFAGVDATTTTGXAAGRTTSGLTXLFXPGAKQNLQLINTNGSWHINRTALNCNDSLQTGFIAGLFYTHKFNSSGCPERMSSCKPLTDFDQGWGPITYANISGPSEDRPYCWHYAPRPCDVVPARTVCGPVYCFTPSPVVVGTTDRRGLPTYTWGENETDVFLLESLRPPTGGWFGCTWMNSTGFVKTCGAPPCNIXPNSSNNSLLCPTDCFRKHPEATYARCGSGPWLTPRCLVDYPYRLWHYPCTVNFTIHKVRMFVGGVEHRFDAACNWTRGERCELDDRDRIEMSPLLFSTTELAILPCSFTTMPALSTGLIHLHQNIVDVQYLYGVSSSVVSWAVKWEYVVLAFLVLADARICACLWLMLLIGQAEAALENLIVLNAASAASTQGWWWGLLFLCCAWYVKGRLVPACTYALLQLWPLLLLVLALPRRAYAYDNEQAASLGALVLLVITIFTLTPAYKQLLVSFLWWNQYFIARAEAMLHVWVPSLRVRGGRDAVILLTCLLHPQLGFEVTKILLALLGPLYLLQYSLLKVPYFVRAHILLRACLLVRRLAGGKYVQACLLRLGAWTGTYIYDHLAPLSDWASDGLRDLAVAVEPVIFSPMEKKVITWGADTAACGDILAGLPVSARRGNLVLLGPADDMKRGGWRLLAPITAYAQQTRGLLGTIVTSLTGRDKNEVEGEVQVVSTATQSFLATSINGVLWTVYHGAGSKTLAGPKGPVCQMYTNVDQDLVGWPAPPGARSLTPCTCGSSDLYLVTRNADVIPARRRGDTRAALLSPRPISTLKGSSGGPILCPSGHVVGLFRAAVCTRGVAKSLDFVPVENMETTMRSPSFTDNSTPPAVPQTYQVGYLHAPTGSGKSTKVPAAYASQGYKVLVLNPSVAATLGFGSYMSKAHGIDPNIRTGVRTITTGGAITYSTYGKFLADGGCSGGAYDIIICDECHSTDPTTVLGIGTVLDQAETAGVRLTVLATATPPGSVTVPHPNITETALPTTGEIPFYGKAIPLEYIKGGRHLIFCHSKKKCDELAKQLTSLGLNAVAFYRGVDVSVIPTSGDVVVCATDALMTGYTGDFDSVIDCNVAVTQVVDFSLDPTFSIETTTVPQDAVSRSQRRGRTGRGKPGVYRYVSQGERPSGMFDTVVLCEAYDTGCAWYELTPSETTVRLRAYLNTPGLPVCQDHLEFWEGVFTGLTHIDAHFLSQTKQGGENFAYLVAYQATVCARAKAPPPSWDTMWKCLIRLKPMLTGPTPLLYRLGAVQNEITTTHPITKYIMTCMSADLEVITSTWVLVGGVLAALAAYCLSVGCVVICGRITTTGKPAVIPDREVLYQQFDEMEECSRHIPYLAEGQQIAEQFKQKVLGLLQTTAKQAEELKPAVHSAWPKLEQFWQKHLWNFVSGIQYLAGLSTLPGNPAVASLMSFSASLTSPLSTSTTLLLNILGGWVASQLAPPTASTAFVVSGLAGAAVGSIGLGRVLVDILAGYGAGVSGALVAFKIMSGETPAXEDMVNLLPALLSPGALVVGVVCAAILRRHVGPAEGATQWMNRLIAFASRGNHVSPTHYVPETDASRXVTTILSSLTITSLLRRLHEWINXDWSTPCATSWLRDIWDWVCTVLSDFKTWLKAKLVPSLPGIPFLSCQRGFRGVWRGDGVCHTTCTCGAVIAGHVKNGTMKISGPRTCSNTWHGTFPINATTTGPSVPIPEPNYKRALWRVSAEDYVEVVRVGDCHYVVGATADNLKCPCQVPAPEFFTEVDGVRLHRYAPPCKPLLRDEVTFSVGLSSYAIGSQLPCEPEPDVTVVTSMLTDPSHITAETAARRLARGSPPSLASSSASQLSAPSLKATCTTHGDHPDAELIEANLLWRQEMGGNITRVESENKVIVLDSFDPLVAEYDDREISVSAECHRPPRPKFPPALPIWARPDYNPPLLETWKAPDYEPPVVSGCALPPPGPPPIPPPRRKKVVHLDESTVSHALAQLAEKSFPESSSDSTSSDSGLSITSSGSPEPTTDDDACSEAGSYSSMPPLEGEPGDPDLSSGSWSTVSEEDSVVCCSMSYSWTGALITPCAAEEEKLPINPLSNSLIRHHNLVYSTTSRSASLRQKKVTFDRVQVLDQHYQDVLKEIKLRASQVQARLLSTEEACDLTPPHSARSKFGYGAKDVRSHASKAINHINSVWEDLLEDNQTPIPTTIMAKNEVFCVDPSKGGRKPARLIVYPDLGVRVCEKRALYDITRKLPVAVMGDAYGFQYSPKQRVDYLLKMWRSKKTPMGFSYDTRCFDSTVTERDIRTEHDIYQSCQLDPEARKAITSLTERLYVGGPMYNSKGQSCGYRRCRASGVLPTSLGNTLTCYLKAQAACRAAGLKDFDMLVCGDDLVVISESAGVQEDAAALRAFTEAMTRYSAPPGDEPQPTYDLELITSCSSNVSVAHDGTGQRYYYLTRDPTTPLARAAWETARHTPVNSWLGNIIMYAPTIWVRMVLMTHFFQILQSQEQLHKALDFDIYGVTYSITPLDLPAIIQRLHGMAAFSLHGYSPGELNRVAACLRKLGAPPLRAWRHRARAVRAKLIAQGGKAAICGKYLFNWAVKTKLKLTPLRGASKLDLSGWFVAGYSGGDIYHSVSRARPRMLLLCLLLLTVGVGIFLLPAR

SEQ ID NO: 195 - protein, 3013 aa, hepatitis C virus
MSTNPKPQRLTKRNTVRRPQNVKFPGGGQIVGGVYLLPRRGPRLGVRGTRKSSERSQPRGRRQRIPKAASSQGKAWGKPGYPWPLYGNEGCGWAGWLLSPRGSRPTWGPTDPRHRSRNLGKVIDTMTCGFADLMGYIPVLGAPLGGVARALAHGVRVLEDGVNYATGNLPGCSFSIFLLALLSCLTVPASAYEVRNSSGVYHLTNDCPNASIVYETDNAILHEPGCVPCVREGNTSRCWEPVAPTLAVRYRGALTDDLRTHIDLVVASATLCSALYVGDICGAIFIASQAVLWKPGGGRIVQDCNCSIYPGHVTGHRMAWDMMQNWAPALSMVAAYAVRVPGVIITTVAGGHWGVLFGLAYFGMAGNWAKVILIMLLMSGVDAETMAVGARAAHTTGALVSLLNPGPSQRLQLINTNGSWHINRTALNCNDSLQTGFIAALFYTHRFNSSGCPERMASCKPLSDFDQGWGPLWYNSTERPSDQRPYCWHYAPSPCGIVPAKDVCGPVYCFTPSPVVVGTTDRRGVPTYTWGENESDVFLLNSTRPPQGSWFGCSWMNTTGFTKTCGGPPCKIRPQGAQSNTSLTCPTDCFRKHPRATYSACGSGPWLTPRCMVHYPYRLWHYPCTVNFTIHKVRLYIGGVEHRLDAACNWTRGERCDLEDRDRVDMSPLLHSTTELAILPCSFVPLPALSTGLIHLHQNIVDAQYLYGLSPAIISWAIRWEWVVLVFLLLADARICACLWMMMLMAQAEAALENLIHLNAASLAGTHGIWWLLLVFCASWHLRGRVVPLVTYGICGMWPFFLMLLSLPPRAYALDREVSAALGTGMLAIILLVTLGPHYKRLLALILWWVTYFLTRCEAALQTWVPPLNPRGGRDGFILCVLLCYPGLVFDITKWLLVMMCPLYLLQLCLVRTPYFVRAQALIRVCSLFKTLAGGRYVQAALLTIGRWTGTYIYNHLAPLETWAAGGLRDLAVAVEPVIFSPMEKKIIVWGAETTACGDILCGLPVSARLGREVLLGPADDYRSMGWQLLAPISAYAQQTRGLISTLVVSLTGRDKNETAGEVQVLSTSTQTFLGTNVGGVMWGPYHGAGTRTVAGRGGPVLQMYTSVSDDLVGWPAPPGSKSLEPCSCGSADLYLVTRNADVLPLRRKGDGTASLLSPRPVSSLKGSSGGPVLCPQSHCVGIFRAAVCTRGVAKAVQFVPIEKMQVAQRSPSFSDNSTPPAVPSTYQVGYLHAPTGSGKSTKVPAAYASQGYKVLVLNPSVAATLGFGAYMSKAYGIDPSVRTGARTVTTGAPITYSTYGKFLADGGCSGGAYDIIICDECHAIDATTVVGIGTVLDQAETSGVRLVVLATATPPGSVTVPHPNIEEVALGNDGEIPFYGKAIPLQHIKGGRHLIFCHSKKKCDELAGKLTSLGLTAVAYYRGLDVSVIPTSGDVVVVATDALMTGFTGDFDSVIDCNVAVTQTVDFSLDPTFTIETTTVPQDSVSRSQRRGRTGRGRLGIYRYVSSGERPSGMFDTSVLCECYDLGCSWYELTPSETTTRLRAYLNCPGLPVCQDHLEFWEGVFTGLTHIDAHFLSQTKQEGQNYAYLTAYQATVCARAKAPPPSWDVQWKCLQRLKPLLVGPTPLLYRLGSVTNEVTFTHPITKYIATCMAADLEVTTSTWVIVGGVLAAVAAYCMSTGSVVVVGRVVLGSNVVTAPDREVLYQHFDEMEECSKAPELLKHAQTIGGMFKDKALAVLDTLKPAAQAAVPIVETNFQKVEKLWNQHMWNFISGIQYLAGLSTLPGNPTVASLMAFTASVTSPLATSTTLLVNILGGWFASQLAPPSAATTFVVSGLAGAAVGSVGLGKVLVDVLAGYGAGIAGALVAFKIMSGEVPSTEDLANLLPAILSPGALVVGVVCAAIIKRHTGTSEGVTQWMNRLIAFASRGNHVSPTHYIQDDDASKRVMGILSSLTITSLIKRVLAWAQTDYSAPCAGSWLREVWDWVCMVLSDFASWLKAKVLPSLPGIPFLSCQKGYKGEWRNDGIMNTKCPCGALIAGHVKNGSMRIVGPKTCRNTWWGTFPINSHTTGPSSPVPSHCYQRALWRVSATEYVEILRHNDQHYVVGVTAEDLKCPCQVPSPEFFSFVDGVRIHRFAPEPKPMIREEAAFVVGLHSYVVGSQLPCEPEPDVQTVSQLLTDPSHITAETAARRLRRGSPPSNASSSASQLSAPSLKATHTTLPQHPDAELIEANLMWEHKVGAIRRMETDTKVIILDSFDSASSVEDDMEPSTAAECLRTRKVFPPAMPIWARPDYNPPVVENWKDPEYAPPQVSGCALPPAQTPPVPPPRRKRAVIQLTESAVSTALAELAERSFPKEEAPPSDSAISLDSPAANDPPSDCDQGSEISFSSMPPLEGEPGDPDLSDGSWSTVSTRSDVICCSMSYSWTGALVTPSGPEEERLPINALSNTMLRHYNMVYSTTSRSASQRAKKVTFDRLQVLDDHYKRALADVKADASTVKAQLLSVEEAAALTPAHSARSKFGYGAKEVRSLAPKAMSHIKEVWKDLLQDMTTPIPTTIMAKNEVFCVNPAKGGKKPARLIVYPDLGVRVCEKRALYDIAQKLPKAIMGQAYGFQYSPSQRVEYLVKTWKSKRTPMGFSYDTRCFDSTVTEQDIRTESEIYQCCNLDPEARTIINALTERLYVGGPMFNSKGQRVGYRRCRASGVFPTSMGNTMTCYIKAKAAAAAAGLESTDFLVCGDDLVVICESKGVERDRADLQAFAAAMTRYSAPPGDMPQPAYDLEHIDSCSSNVSVARDNSGKRVYYLTRDPTNPLSRAAWETARHSPVNSWVGNIIMFAPTIWVRMVLMTHFFALLLNEERLNDPVSFEMYGATYTVCPTDLPDIIQRLHGLRAFELHTYSPAELTRVAATLRKLGVPPLRTWRQRARKVRAGLIGQGGRARICGLYLFNWAVRTKIKLTPLAGAGRLDLSSWFSVCAGEADVDHSTPRAHPRPLLLCLLLLAVGVGIFLLPAR

SEQ ID NO: 196 - protein, 3008 aa, hepatitis C virus
  misc_feature (1871)..(1871): Xaa can be any naturally occurring amino acid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGLYHVTNDCPNSSIVYEAADAILHTPGCVPCVREGNTSRCWVAMTPTVATRDGKLPTTQLRRHIDLLVGSATLCSALYVGDLCGSVFLVGQMFTFSPRRHWTTQDCNCSLYPGHITGHRMAWDMMMNWSPTAALITAQLLRIPQAILDMIAGAHWGVLAGIAYFSMVGNWAKVLVVLLLFAGVDAQTHVTGGRAAHITAGLTSLFSPGPSQKLQLVNTNGSWHINSTALNCNDSLKTGWIAGLLYSYKFNSSGCPERLASCRRLTDFAQGWGPISHANGSGPDERPYCWHYPPRPCGIVPAKSVCGPVYCFTPSPVVVGTTDKSGAPTYNWGENDWDVFVLNNTRPPLGNWFGCTWMNSTGFTKVCGAPPCVIGGAGNNTLRCPTDCFRKHPDATYSRCGSGPWITPRCLVDYPYRLWHYPCTVNYSIFKIRMYLGGVEHRLEAACNWTRGERCDLEDRDRSELSPLLLSTTQWQVLPCSFTTLPALSTGLIHLHQNIVDVQYLYGVGSSVASWAIKWDYVVLLFLLLADARICSCLWMMLLISQAEAALENLVVLNAASLAGTHGLAPFLVFFCLAWYLKGKWAPGAVYAVYGMWPLLLLLLALPQRAYALDTEVAASCGGAVLVGLMVLTLSPHYKHYISWCLWWLQYFLTRAEAQLHVWVPPLNVRGGRDAVILLMCVVHPTLVFDITKLLLAVGPLWILQTSLLKVPYFVRVQGLLRICALARKIAGGHYVQMAIIKLGALTGTYIYDHLTPLRDWAHNGLRDLAVAVEPVVFSRMETKLITWGADTAACGDIINGLPVSARRGQEILLGPADGMVSKGWRLLAPITAYAQQTRGLLGCIITSLTGRDKNQVEGEVQIVSTAAQTFLATCINGVCWTVYHGAGTRTIASPKGPVIQMYTNVDKDLVGWPAPPGSRSLTPCTCGSSDLYLVTRHADVIPVRRRGDSRGSLLSPRPISYLKGSSGGPLLCPAGHAVGIFRAAVCTRGVAKAVDFIPVESLETTMRSPVFTDNSSPPVVPQSFQVAHLHAPTGSGKSTKVPAAYAAQGYKVLVLNPSVAATLFGAYMSKAHGVDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGYTGDFDSVIDCNTCVTQTVDFSLDPTFTIETTTLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENFPYLVAYQATVCARAQAPPPSWDQMWKCLIRLKPTLHGPTPLLYRLGAVQNEVVLTHPITKYIMTCMSADLEVVTSTWVLVGGVLAALAAYCLSTGCVVIVGRVVLSGKPAIIPDREVLYQEFDEMEECSQHLPYIEQGMMLAEQFKQKALGLLQTASRQAEVIAPAVQTNWQKLEAFWAKHMWNFISGIQYLAGLSTLPGTPAIASLMAFTAAVTSPLTTSQTLLFNILGGWVAAQLAAPGAATAFVGAGLAGAAIGSVGLGKVLVDILAGYGAGVAGALVAFKIMSGEXPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYKFALWRVSAEEYVEIRQVGDFHYVTGMTTDDLKCPCQVPSPEFFTELDGVRLHRFAPPCKPLLREEVSFRVGLHAYPVGSQLPCEPEPDVAVLTSMLTDPSHITAETARRLARGSPPSVASSSASQLSAPSLKATCTANHDSPDAELIEANLLWRQEMGGNITRVESENKVVILDSFDPLVAEEDEREISVPAEILRKSRRFTQALPVWARPDYNPPLVEAWKKPDYEPPVVHGCPLPPPKSPPVPPPRKKRTVVLTESTLSTALAELATKSFGSSSTSGITGDNTTTSSEPAPPGCSPDSDAESCSSMPPLEGEPGDPDLSDGSWSTVSSEADTEDVVCCSMSYTWTGALITPCAAEEQKLPINALSNSLLRHHNLVYSTTSRSACQRQKKVTFDRLQVLDNHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVFPDLGVRVCEKMALYDVVSKLPLAVMGDSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKAKAACRAAGLQNCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMVLMTHFFSVLIARDQLEQALDCEIYGACYSIEPLDLPPIIQRLHGLSAFSLHSYSPGEINRVAACLRKLGVPPLRTWRHRARSVRAKLLSRGGRAAICGKYLFNWAVRTKLKLTPIAAAGRLDLSGWFTAGYSGGDIYHSVSHARPRWFWFCLLLLAAGVGIYLLPNR

SEQ ID NO: 197 - protein, 3021 aa, hepatitis C virus
MSTLPKPQRKTKRNTIRRPQDVKFPGGGQIVGGVYVLPRRGPRLGVRATRKTSERSQPRERRQPIPKARRSDGRSWAQPGYPWPLYGNEGCGWAGWLLSPRGSRPSWGPNDPRRRSRNLGKVIDTLTCGFADLMGYIPIVGAPVGGVARALAHGVRALEDGINFATGNLPGCSFSIFLLALLSCLIHPAASLEWRNTSGLYILTNDCPNSSIVYEADDVILHTPGCIPCVQDGNTSTCWTSVSPTVAVRYVGATTASIRSHVDLLVGAATLCSALYVGDMCGAVFLVGQAFTFRPRRHQTVQTCNCSLYPGHLTGHRMAWDMMMNWSPAVGMVVAHVLRMPQTVFDIIAGAHWGILAGLAYYSMQGNWAKVAIIMVMFSGVDAETHTTGGTAARNAFTLTGLFTQGARQKLQLINTNGSWHINRTALNCNESLNTGFIAGLFYLHKFNSTGCPERLSSCKPITFFRQGWGSLTDANITGPSDDKPYCWHYAPRPCEVVPALNVCGPVYCFTPSPVVVGTTDRQGVPTYTWGENETDVFLLRSLRPPSGQWFGCTWMNSTGFVKTCGAPPCDIYGGGGNRCNESDLFCPTDCFRKHPEATYSRCGAGPWLTPRCLVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSGVVGWALRWEFVVLVFLLLADARVCVALWLMLMISQAEAALENLVTLNAVAAAGTHGIGWYLVAFCAAWHLRGKLVPLVTYSLTGLWSLAVLVLLLPQRAYAWSGEDSATLGAGILVLFGFFTLSPWYKHWIGRLMWWNQYTICRCEAALQVWVPPLLARGSRDGAILLTSLLYPSLIFDITKLLIAVLGPLYLIQAAITTTPYFVRAHVLVRLCMLVRSVMGGKYFQMIILSIGRWFNTYLYDHLAPMQHWAAAGLKDLAVATEPVIFSPMEIKVITWGADTAACGDILCGLPVSARLGHEVLLGPADDYREMGWRLLAPITAYAQQTRGLLGTIVTSLTGRDKNVVTGEVQVLSTATQTFLGTTIGGVMWTVYHGAGSRTLAGVKHPALQMYTNVDQDLVGWPAPPGAKSLEPCSCGSTDLYLVTREADVIPARRRGDSTASLLSPRPLACLKGSSGGPVMCPSGHVAGIFRAAVCTRGVAKALQFIPVETLSAQARSPSFSDNSTPPIVPQSYQVGYLHAPTGSGKSTKVPAAYVAQGYNVLVLNPSVAATLGFGSFMSRAYGIDPNIRTGNRTVTTGAKLTYSTYGKFLADGGCSGGAYDVIICDECHAQDATSILGIGTVLDQAETAGVRLTVLATATPPGSITVPHSNIEEVALGSEGEIPFYGKAIPLAQLKGGRHLIFCHSKKKCDEMASKLRGMGLNAVAYYRGLDVSVIPTAGDVVVCATDALMTGFTGDFDSVIDCNVTVEQYVDFSLDPTFSIETRTAPQDAVSRSQRRGRTGRGRLGTYRYVAPGERPSGMFDSVVLCECYDAGCSWYDLQPAETTVRLRAYLSTPGLPVCQDHLDFWESVFTGLTHIDAHFLSQTKQQGLNFSYLTAYQATVCARAQAPPPSWDEMWKCLLRLKPTLHGPTPLLYRLGPVQNETCLTHPVTKYIMACMSADLEVTTSTWVLLGGVLAALAAYCLSVGCVVIVGHIELGGKPALIPDKEVLYQQYDEMEECSQAAPYVEQAQAIAHQFKEKLLGLLQRATQQQAVIEPIVATNWQKLEAFWHKHMWNFVSGIQYLAGLSTLPGNPAVASLMAFTASVTSPLTTNQTMFFNILGGWVATHLAGPQSSSAFVVSGLAGAAIGGIGLGRVLLDILAGYGAGVSGALVAFKIMGGEIPTAEDMVNLLPAILSPGALVVGVICAAILRRHVGPGEGAVQWMNRLIAFASRGNHVSPTHYVPESDAAARVTALLSSLTVTSLLRRLHHWINEDYPSPCSGDWLRTIWDWVCMVLSDFRTWLSAKIMPALPGLPFLSCQKGYKGVWRGDGVVSTRCPCGASITGHVKNGSMRLAGPRTCANMWHGTFPINEYTTGPSTPCPSPNYTRALWRVAANSYVEVRQVGDFHYITGATEDGLKCPCQVPAAEFFTEVDGVRLHRYAPPCKPLLRDEITFMVGLNSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAEADDAELSVAAECFKKPPKYPPALPIWARPDYNPPLLDRWKTPDYVPPTVHGCALPPRGAPPVPPPRRKRTVQLDGSNVSAALAALAEKSFPSLEPQGENSSSSGIDIQSSTASEVPPSPEGESDSESCTSMPPLEGEPGDPDLSCDSWSTVSDSEEQSVVCCSMSYSWTGALITPCSAEEEKLPISPLSNSLLRHHNLVYSTSSRSASQRQKKVTFDRLQVLDDHYKAVLKEVKERASRVKARMLTIEEACALVPPHSARSKFGYSAKDVRSLSGRAVNQIRSVWEDLLEDTTTPIPTTIMAKNEVFCVDPSKGGRKPARLIVYPDLGVRVCEKRALYDVIQKLSIATMGSAYGFQYSPQQRVERLLEMWTSKKTPMGFSYDTRCFDSTVTEQDIRVEEEIYQCCNLEPEARKVISSLTERLYCGGPMFNSKGAQCGYRRCRASGVLPTSFGNTITCYIKATAAARAAGLRNPDFLVCGDDLVLVAESDGVDEDRAALRAFTEAMTRYSAPPGDAPQPTYDLELITSCSSNVSVARDNKGKRYYYLTRDATTPLARAAWETARHTPVNSWLGNIIMYAPTIWVRMVMMTHFFSILQSQEILDRPLDFEMYGATYSVTPLDLPAIIERLHGLSAFTLHSYSPVELNRVAGTLRKLGCPPLRAWRHRARAVRAKLIAQGGKAKICGLYLFNWAVRTKTNLTPLPAAGQLDLSSWFTVGVGGNDIYHSVSRARTRHLLLCLLLLTVGVGIFLLPAR

What is claimed is:

1. A heterodimeric polypeptide comprising:
   a) a variant hepatitis C virus (HCV) E2 polypeptide comprising:
      i) an HCV E2 polypeptide; and
      ii) a heterologous polypeptide comprising a T-cell epitope present in an HCV protein other than E1 and E2,
   wherein the heterologous polypeptide comprises an amino acid sequence having at least 20% amino acid sequence identity to the amino acid sequence selected from the group consisting of:

(SEQ ID NO: 1)
   AIPLEVIKGGRHLIFCHSKKKCDELAAKL;

(SEQ ID NO: 2)
   AIPLEVIKGGRHLIFCHSKKKCDELAAKLVALGINAVAYYRGLDVSVIP
   TSG;

(SEQ ID NO: 3)
   KGGRHLIFCHSKKKCDELAAKLVALGINAVAYYRGLDVSVIPTSGDVVV
   VATDALMTGFTGDFDSVIDCN;
   and (SEQ ID NO: 4)
   VALSTTGEIPFYGKAIPLEVIKGGRHLIFCHSKKKCDELAAKLVALGIN
   AVAYYRGLDVSVIPTSGDVVVVATDALMTGFTGDFDSVIDCNTCVTQTV
   DF;
   and
   b) an HCV E1 polypeptide.

2. The heterodimeric polypeptide of claim 1, wherein:
   a) the HCV E2 polypeptide is derived from an HCV of genotype 1, 2, 3, or 7; and
   b) the HCV E1 polypeptide is derived from an HCV of genotype 1, 2, 3, or 7.

3. The heterodimeric polypeptide of claim 1, wherein the HCV E2 polypeptide comprises an amino acid sequence having at least 20% amino acid sequence identity to an E2 polypeptide depicted in one of FIG. 1A-1C, FIG. 2A-2C, FIG. 3A-3C, and FIG. 4A-4B.

4. The heterodimeric polypeptide of claim 1, wherein the heterologous polypeptide has a length of from about 29 amino acids to about 100 amino acids.

5. The heterodimeric polypeptide of claim 1, wherein the heterologous polypeptide comprises an amino acid sequence having at least 50% amino acid sequence identity to

AIPLEVIKGGRHLIFCHSKKKCDELAAKL (SEQ ID NO:1).

6. The heterodimeric polypeptide of claim 1, wherein the variant HCV E2 polypeptide comprises, in order from N-terminus to C-terminus:
   i) the heterologous polypeptide and the HCV E2 polypeptide; or
   ii) the HCV E2 polypeptide and the heterologous polypeptide.

7. The heterodimeric polypeptide of claim 1, wherein the heterologous polypeptide comprises one or more T cell epitopes present in:
   a) cholera toxin or toxoid; and/or b) tetanus toxin or toxoid; and/or c) diphtheria toxin or toxoid; and/or d) CRM197.

8. The heterodimeric polypeptide of claim 1, wherein the E2 polypeptide and/or the E1 polypeptide lacks a C-terminal transmembrane domain.

9. The heterodimeric polypeptide of claim 1, wherein the modified HCV E2 polypeptide and the HCV E1 polypeptide are derived from:

i) an HCV of the same genotype; or ii) an HCV of different genotypes.

10. The heterodimeric polypeptide of claim 1, wherein the HCV E1 polypeptide comprises an amino acid sequence having at least 20% amino acid sequence identity to an E1 polypeptide depicted in FIG. 1A-1C, FIG. 2A-2C, FIG. 3A-3C, and FIG. 4A-4B.

11. A heterodimeric polypeptide comprising:

a) a variant hepatitis C virus (HCV) E1 polypeptide comprising:

i) an HCV E1 polypeptide; and ii) a heterologous polypeptide comprising a T-cell epitope present in an HCV protein other than E1and E2, wherein the heterologous polypeptide comprises an amino acid sequence having at least 20% amino acid sequence identity to the amino acid sequence selected from the group consisting of:

(SEQ ID NO: 1)
AIPLEVIKGGRHLIFCHSKKKCDELAAKL;

(SEQ ID NO: 2)
AIPLEVIKGGRHLIFCHSKKKCDELAAKLVALGINAVAYYRGLDVSVIP

TSG;

(SEQ ID NO: 3)
KGGRHLIFCHSKKKCDELAAKLVALGINAVAYYRGLDVSVIPTSGDVVV

VATDALMTGFTGDFDSVIDCN;
and (SEQ ID NO: 4)
VALSTTGEIPFYGKAIPLEVIKGGRHLIFCHSKKKCDELAAKLVALGIN

AVAYYRGLDVSVIPTSGDVVVVATDALMTGFTGDFDSVIDCNTCVTQTV

DF;
and b) an HCV E2 polypeptide.

12. The heterodimeric polypeptide of claim 11, wherein:

a) the HCV E2 polypeptide is derived from an HCV of genotype 1, 2, 3, or 7; and b) the HCV E1 polypeptide is derived from an HCV of genotype 1, 2, 3, or 7.

13. The heterodimeric polypeptide of claim 11, wherein the HCV E1 polypeptide comprises an amino acid sequence having at least 20% amino acid sequence identity to an E1 polypeptide depicted in one of FIG. 1A-1C, FIG. 2A-2C, FIG. 3A-3C, and FIG. 4A-4B, and wherein the HCV E2 polypeptide comprises an amino acid sequence having at least 20% amino acid sequence identity to an E2 polypeptide depicted in one of FIG. 1A-1C, FIG. 2A-2C, FIG. 3A-3C, and FIG. 4A-4B.

14. The heterodimeric polypeptide of claim 11, wherein the heterologous polypeptide has a length of from about 29 amino acids to about 100 amino acids.

15. The heterodimeric polypeptide of claim 11, wherein the heterologous polypeptide comprises an amino acid sequence having at least 50% amino acid sequence identity AIPLEVIKGGRHLIFCHSKKKCDELAAKL (SEQ ID NO:1).

16. The heterodimeric polypeptide of claim 11, wherein the variant HCV E1 polypeptide comprises, in order from N-terminus to C-terminus:

i) the heterologous polypeptide and the HCV E1 polypeptide; or ii) the HCV E1 polypeptide and the heterologous polypeptide.

17. The heterodimeric polypeptide of claim 11, wherein the heterologous polypeptide comprises one or more T cell epitopes present in:

a) cholera toxin or toxoid; and/or b) tetanus toxin or toxoid; and/or c) diphtheria toxin or toxoid; and/or d) CRM197.

18. The heterodimeric polypeptide of claim 11, wherein the modified HCV E2 polypeptide and the HCV E1 polypeptide are derived from:

i) an HCV of the same genotype; or ii) an HCV of different genotypes.

19. A heterodimeric polypeptide comprising:

a) a variant hepatitis C virus (HCV) E1 polypeptide comprising:

i) an HCV E1 polypeptide; and ii) a first heterologous polypeptide comprising a T-cell epitope present in an HCV protein other than E1 and E2, wherein the heterologous polypeptide comprises an amino acid sequence having at least 20% amino acid sequence identity to the amino acid sequence selected from the group consisting of:

(SEQ ID NO: 1)
AIPLEVIKGGRHLIFCHSKKKCDELAAKL;

(SEQ ID NO: 2)
AIPLEVIKGGRHLIFCHSKKKCDELAAKLVALGINAVAYYRGLDVSVIP

TSG;

(SEQ ID NO: 3)
KGGRHLIFCHSKKKCDELAAKLVALGINAVAYYRGLDVSVIPTSGDVVV

VATDALMTGFTGDFDSVIDCN;
and (SEQ ID NO: 4)
VALSTTGEIPFYGKAIPLEVIKGGRHLIFCHSKKKCDELAAKLVALGIN

AVAYYRGLDVSVIPTSGDVVVVATDALMTGFTGDFDSVIDCNTCVTQTV

DF;
and b) a variant hepatitis C virus (HCV) E2 polypeptide comprising:

i) an HCV E2 polypeptide; and ii) a second heterologous polypeptide comprising a T-cell epitope present in an HCV protein other than E1 and E2, wherein the heterologous polypeptide comprises an amino acid sequence having at least 20% amino acid sequence identity to the amino acid sequence selected from the group consisting of:

(SEQ ID NO: 1)
AIPLEVIKGGRHLIFCHSKKKCDELAAKL;

(SEQ ID NO: 2)
AIPLEVIKGGRHLIFCHSKKKCDELAAKLVALGINAVAYYRGLDVSVIP

TSG;

(SEQ ID NO: 3)
KGGRHLIFCHSKKKCDELAAKLVALGINAVAYYRGLDVSVIPTSGDVVV

VATDALMTGFTGDFDSVIDCN;
and (SEQ ID NO: 4)
VALSTTGEIPFYGKAIPLEVIKGGRHLIFCHSKKKCDELAAKLVALGIN

AVAYYRGLDVSVIPTSGDVVVVATDALMTGFTGDFDSVIDCNTCVTQTV

DF.

20. The heterodimeric polypeptide of claim 19, wherein:

a) the HCV E2 polypeptide is derived from an HCV of genotype 1, 2, 3, or 7; and b) the HCV E1 polypeptide is derived from an HCV of genotype 1, 2, 3, or 7.

21. The heterodimeric polypeptide of claim 19, wherein the HCV E1 polypeptide comprises an amino acid sequence having at least 20% amino acid sequence identity to an E1 polypeptide depicted in one of FIG. 1A-1C, FIG. 2A-2C, FIG. 3A-3C, and FIG. 4A-4B, and wherein the HCV E2 polypeptide comprises an amino acid sequence having at least 20% amino acid sequence identity to an E2 polypeptide depicted in one of FIG. 1A-1C, FIG. 2A-2C, FIG. 3A-3C, and FIG. 4A-4B.

22. The heterodimeric polypeptide of claim 1, wherein the heterologous polypeptide comprises an amino acid sequence having at least 50% amino acid sequence identity to (SEQ ID NO: 2)
AIPLEVIKGGRHLIFCHSKKKCDELAAKLVALGINAVAYYRGLDVSVIPT
SG.

23. The heterodimeric polypeptide of claim 1, wherein the heterologous polypeptide comprises an amino acid sequence having at least 50% amino acid sequence identity to (SEQ ID NO: 3)
KGGRHLIFCHSKKKCDELAAKLVALGINAVAYYRGLDVSVIPTSGDVVVVA
TDALMTGFTGDFDSVIDCN.

24. The heterodimeric polypeptide of claim 1, wherein the heterologous polypeptide comprises an amino acid sequence having at least 50% amino acid sequence identity to (SEQ ID NO: 4)
VALSTTGEIPFYGKAIPLEVIKGGRHLIFCHSKKKCDELAAKLVALGINAV
AYYRGLDVSVIPTSGDVVVVATDALMTGFTGDFDSVIDCNTCVTQTVDF.

25. The heterodimeric polypeptide of claim 11, wherein the heterologous polypeptide comprises an amino acid sequence having at least 50% amino acid sequence identity to (SEQ ID NO: 2)
AIPLEVIKGGRHLIFCHSKKKCDELAAKLVALGINAVAYYRGLDVSVIPT
SG.

26. The heterodimeric polypeptide of claim 11, wherein the heterologous polypeptide comprises an amino acid sequence having at least 50% amino acid sequence identity to (SEQ ID NO: 3)
KGGRHLIFCHSKKKCDELAAKLVALGINAVAYYRGLDVSVIPTSGDVVVV

ATDALMTGFTGDFDSVIDCN.

27. The heterodimeric polypeptide of claim 11, wherein the heterologous polypeptide comprises an amino acid sequence having at least 50% amino acid sequence identity to (SEQ ID NO: 4)
VALSTTGEIPFYGKAIPLEVIKGGRHLIFCHSKKKCDELAAKLVALGINAV

AYYRGLDVSVIPTSGDVVVVATDALMTGFTGDFDSVIDCNTCVTQTVDF.

* * * * *